United States Patent
Shalitin et al.

(10) Patent No.: US 11,716,996 B2
(45) Date of Patent: Aug. 8, 2023

(54) **COMPOSITIONS AND METHODS FOR MITIGATING PEST INFESTATION WITH *RHYNCHOPHORUS FERRUGINEUS***

(71) Applicants: PLANTARCBIO LTD., Raanana (IL); MERHAV AGRO LTD., Givat Brenner (IL)

(72) Inventors: Dror Shalitin, Raanana (IL); Noam Grimberg, Kibbutz Lehavot Haviva (IL); Nir Mogilner, Kibbutz Hatzor-Ashdod (IL)

(73) Assignees: PLANTARCBIO LTD., Raanana (IL); MERHAV AGRO LTD., Givat Brenner (IL)

( * ) Notice: Subject to any disclaimer, the term of this patent is extended or adjusted under 35 U.S.C. 154(b) by 0 days.

(21) Appl. No.: 17/260,194

(22) PCT Filed: Jul. 17, 2019

(86) PCT No.: PCT/IL2019/050804
§ 371 (c)(1),
(2) Date: Jan. 13, 2021

(87) PCT Pub. No.: WO2020/016892
PCT Pub. Date: Jan. 23, 2020

(65) Prior Publication Data
US 2021/0267216 A1    Sep. 2, 2021

Related U.S. Application Data

(60) Provisional application No. 62/699,853, filed on Jul. 18, 2018.

(51) Int. Cl.
*C12N 15/82* (2006.01)
*A01N 63/60* (2020.01)
*C12N 15/113* (2010.01)

(52) U.S. Cl.
CPC ............ *A01N 63/60* (2020.01); *C12N 15/113* (2013.01); *C12N 15/8218* (2013.01); *C12N 15/8286* (2013.01); *C12N 2310/14* (2013.01)

(58) Field of Classification Search
CPC ..................................................... A01N 63/60
USPC ....................................................... 800/279
See application file for complete search history.

(56) References Cited

U.S. PATENT DOCUMENTS

| 7,943,819 | B2 | 5/2011 | Baum et al. |
| 9,238,822 | B2 | 1/2016 | Baum et al. |
| 9,596,851 | B1 | 3/2017 | Al-Jabr et al. |
| 2007/0124836 | A1 | 5/2007 | Baum et al. |
| 2009/0238805 | A1 | 9/2009 | Raemaekers et al. |
| 2009/0265818 | A1 | 10/2009 | Herrmann et al. |
| 2012/0164205 | A1 | 6/2012 | Baum et al. |
| 2012/0174258 | A1 | 7/2012 | Narva et al. |
| 2014/0275208 | A1* | 9/2014 | Hu .......................... A01N 63/60 435/418 |
| 2015/0065557 | A1 | 3/2015 | Raemaekers et al. |
| 2015/0337302 | A1 | 11/2015 | Donohue et al. |
| 2016/0333376 | A1 | 11/2016 | Esvelt et al. |
| 2017/0044560 | A1* | 2/2017 | Paldi ....................... A01N 25/02 |
| 2017/0253887 | A1 | 9/2017 | Hu et al. |

FOREIGN PATENT DOCUMENTS

| WO | 2007033436 A1 | 3/2007 |
| WO | 2008027592 A2 | 3/2008 |
| WO | 2016018887 A1 | 2/2016 |
| WO | 2017132330 A1 | 8/2017 |

OTHER PUBLICATIONS

Laudani et al. Open Life Science 12:214-222 (Year: 2017).*
Laudani et al. Open Life Sci. 12:214-222 (Year: 2017).*
Kravchuk et al. BBA—Protein and Proteomics 1867 840-853 (Year: 2019).*
Gordon et al (2007) RNAi for insect-proof plants, Nature Biotechnology, 25(11):1231-1232.
Joga et al (2016) RNAi Efficiency, Systemic Properties, and Novel Delivery Methods for Pest Insect Control: What We Know So Far, Frontiers in Physiology, vol. 7, Article 563.
Ulrich et al (2015) Large scale RNAi screen in Tribolium reveals novel target genes for pest control and the proteasome as prime target, Genomics 16:674.
Baum et al (2007) Control of coleopteran insect pests through RNA interference, Nature Biotechnology, vol. 25, 11:1322-1326.
Al-Ayedh et al (2016) Insecticidal potency of RNAi-based catalase knockdown in *Rhynchophorus ferrugineus* (Oliver) (Coleoptera: Curculionidae), Pest Manag Sci 72(11):2118-2127.
Laudani et al (2017) RNAi-mediated gene silencing in *Rhynchophorus ferrugineus* (Oliver) (Coleoptera Curculionidae), Open Life Sciences, 12(1): 214-222.
PCT Search Report for International Application No. PCT/IL2019/050804; dated Sep. 16, 2019; 6 pp.
PCT Search Report for International Application No. PCT/IL2019/050804; dated Sep. 16, 2019; 5 pp.
PCT Search Report for International Application No. PCT/IL2019/050804; dated Jan. 19, 2021; 6 pp.
Ocimati et al. (2016) Suppression of the ubiquitin E2 gene through RNA interference causes mortality in the banana weevil, *Cosmopolites sordidus* (Germar), Acta Horticulturae, No. 1114, pp. 181-190; Retrieved Sep. 29, 2021; DOI: 10.17660/ActaHortic.2016.1114.25.

(Continued)

*Primary Examiner* — Li Zheng
(74) *Attorney, Agent, or Firm* — Scott H. Blackman; Booth Udall Fuller, PLC (57) ABSTRACT dsRNA for preventing, mitigating and/or treating infestation of a plant with red palm weevil (*Rhynchophorus ferrugineus*), the dsRNA comprising a polynucleotide sequence which is about 85% to about 100% complementary to a segment of a target gene of the red palm weevil, wherein ingestion of the dsRNA polynucleotide by the red palm weevil results in mortality and/or stunting thereof.

9 Claims, 4 Drawing Sheets
Specification includes a Sequence Listing.

(56) References Cited

OTHER PUBLICATIONS

Hu et al. (2016) Discovery of midgut genes for the RNA interference control of corn rootworm, Sci. Rep. 6, 30542; Retrieved Sep. 29, 2021; doi: 10.1038/srep30542.

Antony et al. (2018) Silencing the Odorant Binding Protein RferOBP1768 Reduces the Strong Preference of Palm Weevil for the Major Aggregation Pheromone Compound Ferrugineol, Frontiers in Physiology, vol. 9, 252. Retrieved Sep. 29, 2021; doi: 10.3389/fphys.2018.00252.

Soffan et al. (2016) Silencing the Olfactory Co-Receptor Rfer0rco Reduces the Response to Pheromones in the Red Palm Weevil, *Rhynchophorus ferrugineus*, PLoS One, vol. 11, No. 9. Retrieved Sep. 29, 2021; DOI:10.1371/journal.pone.0162203.

Aldosary et al (2015) Review on the Management of Red Palm Weevil *Rhynchophorus ferrugineus* Olivier in Date Palm *Phoenix dactylifera* L, Emirates Journal of Food and Agriculture, vol. 28, No. 1, p. 34; Retrieved Sep. 29, 2021; doi: 10.9755/ejfa.2015-10-897.

\* cited by examiner

COMPOSITIONS AND METHODS FOR MITIGATING PEST INFESTATION WITH *RHYNCHOPHORUS FERRUGINEUS*

This application is a National Phase of PCT Patent Application No. PCT/IL2019/050804 having International filing date of Jul. 17, 2019, which claims the benefit of priority of U.S. Provisional Patent Application No. 62/699,853, filed Jul. 18, 2018, the contents of which are all incorporated herein by reference in their entirety.

FIELD OF INVENTION

This present disclosure relates to RNA interference-mediated inhibition of target genes of pests, particularly red palm weevil (*Rhynchophorus ferrugineus*). The disclosure also relates to transgenic plants that express dsRNA molecules useful for the control of pests.

BACKGROUND OF THE INVENTION

Insect pests cost billions of dollars in the form of crop losses and insecticides, and farmers face an ever-present threat of insecticide resistance, fueling a continual search for alternative pest-control strategies.

The red palm weevil *R. ferrugineus* is a highly invasive beetle infesting palms. The adult beetles are relatively large, ranging between two and four centimeters long, and are usually a rusty red color.

The weevil larvae excavate holes in the trunk of palm trees up to a meter long, thereby weakening and eventually killing the host plant. As a result, the weevil is considered a major pest in palm plantations, including coconut palms, date palms and oil palms.

It is native to southern Asia and Melanesia, but since the 1980s it has rapidly expanded its geographical range westwards. It reached Saudi Arabia and the United Arab Emirates in about 1985, spreading throughout the Middle East and into Egypt. In 1994 it was detected in Spain and in 1999 in Israel, Jordan and the Palestinian Authority Territories. It has since spread widely in the Mediterranean region where the two main palm species of concern are date palm and Canary Island date palm (*Phoenix canariensis*), the main crop and ornamental species. It also attacks several other ornamental palms that are regularly imported into Britain, such as chusan palm (*Trachycarpus fortunei*). It has devastated ornamental palms in many areas of the Mediterranean, changing the landscape, and the European Commission has consequently introduced emergency measures to prevent the further spread of *R. ferrugineus*.

Substantial progress has been made in the last a few decades towards developing efficient methods and compositions for controlling insect infestations in plants. Especially, chemical pesticides have been very effective in eradicating pest infestations. However, there are several disadvantages to using chemical pesticidal agents. Applications of chemical pesticides intended to control pests exert their effects on non-target fauna as well, often effectively sterilizing a field for a period of time over which the pesticidal agents have been applied. Chemical pesticidal agents persist in the environment and generally are slow to be metabolized, if at all. They accumulate in the food chain, and accumulations of these chemical pesticidal agents result in the development of resistance to the agents and may often be hazardous to end consumers.

Thus, there is a long felt need for environmentally friendly methods for controlling or eradicating insect infestation on or in plants, i.e., methods that are selective, environmentally inert, non-persistent, and biodegradable, and that fit well into pest resistance management schemes.

RNA interference (RNAi) is a process utilizing endogenous cellular pathways, whereby an interfering RNA (iRNA) also referred to as RNA interference (RNAi) molecule (e.g., a dsRNA molecule) that is specific for all, or any portion of adequate size, of a target gene sequence, results in the degradation of the mRNA encoded thereby.

Only transcripts complementary to the small interfering RNA (siRNA) and/or microRNA (miRNA) are cleaved and degraded, and thus the knock-down of mRNA expression is sequence-specific.

However, the efficiency of RNAi often varies greatly between different insects. Therefore, there is a need for identifying efficacious nucleotide sequences for use in repressing, delaying or otherwise reducing gene expression within a particular pest species, such as, but not limited to, red palm weevil for the purpose of controlling infestation.

SUMMARY OF THE INVENTION

According to some embodiments, the invention provides a method of inhibiting expression of a target gene in a coleopteran pest, such as, but not limited to, red palm weevil. In certain embodiments, the method comprises modulating or inhibiting expression of one or more target genes in the pest that causes cessation of feeding, growth, development, reproduction, infectivity and/or death of the pest. The method comprises introduction of double-stranded RNA (dsRNA), including its modified forms, such as small interfering RNA (siRNA) sequences, into the cells or into the extracellular environment of the pest, wherein the dsRNA inhibits expression of at least one target gene and wherein the inhibition exerts a deleterious effect in the pest. The methods and associated compositions may be used for limiting or eliminating pest infestation in or on any pest host, pest symbiont, or environment in which a pest is present, by providing one or more compositions comprising the dsRNA molecules described herein to the pest, for example in the diet of the pest or in/on the plant upon which it feeds. The method will find particular benefit for protecting plants from insect attack.

According to some embodiments, there is provided a dsRNA for controlling, preventing, mitigating and/or treating infestation of a plant with a pest, the dsRNA comprising a polynucleotide sequence which is about 85% to about 100% complementary to at least a fragment of a target gene of the pest, wherein ingestion of said dsRNA polynucleotide by said pest results in mortality and/or stunting thereof. According to some embodiments, there is provided a dsRNA for controlling, preventing, mitigating and/or treating infestation of a plant with a pest which comprises the targeted killing of the pest e.g. at its larval stage.

According to some embodiments, the pest may be a red palm weevil (*Rhynchophorus ferrugineus*).

According to some embodiments, the plant is a palm tree of the Arecaceae family. According to some embodiments, the palm tree is selected from *Phoenix dactyhfera*.

According to some embodiments, at least one segment of the dsRNA is complementary to a nucleotide sequence (mRNA) within the cells of the pest. According to some embodiments, the dsRNA inhibits expression of a gene, and or causes degradation of a transcribed gene (mRNA), and/or inhibits gene functioning, wherein the gene encodes at least one of the mRNA sequences set forth SEQ ID Nos.: 1-314 and 335-376.

It is understood by one of ordinary skill in the art that the sequences provided in the sequence listing may include a 'u' representing uracil instead of the 't' representing thymidine, when relating to an RNA molecule. According to some embodiments, the sequences provided in the sequence listing may be coding sequences.

According to some embodiments, the dsRNA has a polynucleotide sequence being about 90% to about 100% complementary to a segment of a target gene of the red palm weevil. According to some embodiments, the dsRNA has a polynucleotide sequence being about 95% to about 100% complementary to a segment of a target gene of the red palm weevil.

According to some embodiments, there is provided a recombinant DNA construct comprising a heterologous promoter operably linked to a dsRNA comprising a polynucleotide sequence which is about 85% to about 100% complementary to at least a segment of a target gene of the pest, wherein ingestion of said dsRNA polynucleotide by said pest results in mortality and/or stunting thereof.

According to some embodiments, the pest may be a red palm weevil (*Rhynchophorus ferrugineus*).

According to some embodiments, the plant is a palm tree of the Arecaceae family. According to some embodiments, the palm tree is selected from *Phoenix dactyhfera*.

According to some embodiments, the gene targeted by the dsRNA has a nucleotide sequence selected from the group consisting of SEQ ID Nos.: 1-314 and 335-376.

According to some embodiments, the gene targeted by the dsRNA has a nucleotide sequence selected from the group consisting of SEQ ID Nos.: 1-26.

According to some embodiments, the gene targeted by the dsRNA has a nucleotide sequence selected from the group consisting of SEQ ID Nos.: 1-6.

According to some embodiments, the gene targeted by the dsRNA has a nucleotide sequence selected from the group consisting of SEQ ID Nos.: 1-26.

According to some embodiments, the gene targeted by the dsRNA has a nucleotide sequence selected from the group consisting of SEQ ID Nos.: 1-12, 14, 16-18, 20, 21, 24, 26, 335, 341-343, 346-348, 352-355, 359, 361, 362, 367 and 371-374.

According to some embodiments, the gene targeted by the dsRNA has a nucleotide sequence of a proteasomal related/associated gene. According to some embodiments, the proteasomal protein related gene has a nucleotide sequence selected from the group consisting of SEQ ID Nos.: 3, 6, 7, 8, 10, 19, 20, 21, 26, 30, 47, 55, 57, 63, 96, 121, 124, 125, 252, 272 and 235-376.

According to some embodiments, the proteasomal related gene has a coding sequence selected from the group consisting of SEQ ID Nos.: 3, 6, 7, 8, 10, 20, 21 and 26.

According to some embodiments, the gene targeted by the dsRNA is a proteasomal alfa subunit related gene. According to some embodiments, the nucleotide sequence of the proteasomal alfa subunit gene has a coding sequence selected from the group consisting of SEQ ID Nos.: 7, 8, 47, 57, 63, 121, 124, 125, 252 and 272.

According to some embodiments, the gene targeted by the dsRNA is a proteasomal beta subunit related gene. According to some embodiments, the proteasomal beta subunit gene has a coding sequence selected from the group consisting of SEQ ID Nos.: 3, 10, 19, 20, 30, 55, 96 and 373-375.

According to some embodiments, the gene targeted by the dsRNA is a 26S proteasome subunit RPN7 related gene. According to some embodiments, the nucleotide sequence encoding the 26S proteasome subunit RPN7 has a nucleotide sequence selected from the group consisting of SEQ ID Nos.: 6, 21 and 26.

According to some embodiments, the gene targeted by the dsRNA is a proteasome-substrate-size regulator related gene. According to some embodiments, the proteasome-substrate-size regulator related gene has a coding sequence selected from the group consisting of SEQ ID Nos.: 335 and 336.

According to some embodiments, the gene targeted by the dsRNA is a Cut8 nuclear proteasome tether subunit related gene. According to some embodiments, the Cut8 nuclear proteasome tether related gene has a coding sequence selected from the group consisting of SEQ ID Nos.: 337-340.

According to some embodiments, the gene targeted by the dsRNA is a proteasome stabilizer related gene. According to some embodiments, the proteasome stabilizer related gene has a coding sequence selected from the group consisting of SEQ ID Nos.: 341-345.

According to some embodiments, the gene targeted by the dsRNA is a JAB1/Mov34/MPN/PAD-1 ubiquitin protease related gene. According to some embodiments, the JAB1/Mov34/MPN/PAD-1 ubiquitin protease related gene has a coding sequence selected from the group consisting of SEQ ID Nos.: 346-351.

According to some embodiments, the gene targeted by the dsRNA is a proteasome activator pa28 beta subunit related gene. According to some embodiments, the proteasome activator pa28 beta subunit related gene has a coding sequence set forth in SEQ ID NO.: 352.

According to some embodiments, the gene targeted by the dsRNA is a proteasome assembly chaperone 4 related gene. According to some embodiments, the proteasome assembly chaperone 4 related gene has a coding sequence set forth in SEQ ID NO: 353.

According to some embodiments, the gene targeted by the dsRNA is a PAC2 family member related gene. According to some embodiments, the PAC2 family member related gene has a coding sequence set forth in SEQ ID NO: 354.

According to some embodiments, the gene targeted by the dsRNA is a proteasome assembly chaperone 3 related gene. According to some embodiments, the proteasome assembly chaperone 3 related gene has a coding sequence selected from the group consisting of SEQ ID Nos.: 355-357.

According to some embodiments, the gene targeted by the dsRNA is a PI31 proteasome regulator. According to some embodiments, the PI31 proteasome regulator related gene has a coding sequence set forth in SEQ ID NO: 358-360.

According to some embodiments, the gene targeted by the dsRNA is a proteasome associated PITH domain containing related gene. According to some embodiments, the proteasome associated PITH domain related gene has a coding sequence selected from the group consisting of SEQ ID Nos.: 361-366.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 367-370.

According to some embodiments, the gene targeted by the dsRNA is a Proteasome complex subunit Rpn13 ubiquitin receptor related gene. According to some embodiments, the Proteasome complex subunit Rpn13 ubiquitin receptor related gene has a coding sequence set forth in SEQ ID NO: 371.

According to some embodiments, the gene targeted by the dsRNA is a nucleotide sequence encoding a proteasome-ubiquitin-receptor Rpn13 UCH-binding domain related gene. According to some embodiments, the proteasome-ubiquitin-receptor Rpn13 UCH-binding domain related gene has a coding sequence set forth in SEQ ID NO: 373.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 368-371.

According to some embodiments, the gene targeted by the dsRNA is a Tat binding protein 1 (TBP-1)-interacting protein (TBPIP) related gene. According to some embodiments, the nucleotide sequence encoding the TBPIP related gene has a coding sequence set forth in SEQ ID NO: 376.

According to some embodiments, the dsRNA has a polynucleotide sequence being about 90% to about 100% complementary to a segment of a target gene of the red palm weevil. According to some embodiments, the dsRNA has a polynucleotide sequence being about 95% to about 100% complementary to a segment of a target gene of the red palm weevil.

According to some embodiments, the promoter may be tissue-specific and may, for example, be specific to a tissue type which is the subject of pest attack. In the case of red palm weevil, for example, it may be desired to use a promoter providing expression in the trunk of the plant and/or xylem and/or phloem tissues.

According to some embodiments, there is provided a host cell having incorporated into its genome a nucleotide sequence, which, when expressed, forms a dsRNA having a polynucleotide sequence which is about 85% to about 100% complementary to a segment of a target gene of the pest, wherein ingestion of said dsRNA polynucleotide by the pest results in mortality and/or stunting thereof.

According to some embodiments, the pest may be a red palm weevil (*Rhynchophorus ferrugineus*).

According to some embodiments, the plant is a palm tree of the Arecaceae family. According to some embodiments, the palm tree is selected from *Phoenix dactyhfera*.

According to some embodiments, the gene targeted by the dsRNA has a coding sequence selected from the group consisting of SEQ ID Nos.: 1-314 and 335-376.

According to some embodiments, the gene targeted by the dsRNA has a coding sequence selected from the group consisting of SEQ ID Nos.: 1-26.

According to some embodiments, the gene targeted by the dsRNA has a coding sequence selected from the group consisting of SEQ ID Nos.: 1-6.

According to some embodiments, the gene targeted by the dsRNA has a coding sequence selected from the group consisting of SEQ ID Nos.: 1-12, 14, 16-18, 20, 21, 24, 26, 335, 341-343, 346-348, 352-355, 359, 361, 362, 367 and 371-374.

According to some embodiments, the gene targeted by the dsRNA is a proteasomal complex related gene. According to some embodiments, the proteasomal complex related gene has a coding sequence selected from the group consisting of SEQ ID Nos.: 3, 6, 7, 8, 10, 20, 21 and 26.

According to some embodiments, the gene targeted by the dsRNA is a proteasomal alfa subunit related gene. According to some embodiments, the nucleotide sequence of the proteasomal alfa subunit gene has a coding sequence selected from the group consisting of SEQ ID Nos.: 7, 8, 47, 57, 63, 121, 124, 125, 252 and 272.

According to some embodiments, the gene targeted by the dsRNA is a proteasomal beta subunit related gene. According to some embodiments, the proteasomal beta subunit gene has a coding sequence selected from the group consisting of SEQ ID Nos.: 3, 10, 19, 20, 30, 55, 96 and 373-375.

According to some embodiments, the gene targeted by the dsRNA is a 26S proteasome subunit RPN7 related gene. According to some embodiments, the nucleotide sequence encoding the 26S proteasome subunit RPN7 has a nucleotide sequence selected from the group consisting of SEQ ID Nos.: 6, 21 and 26.

According to some embodiments, the gene targeted by the dsRNA is a proteasome-substrate-size regulator related gene. According to some embodiments, the proteasome-substrate-size regulator related gene has a coding sequence selected from the group consisting of SEQ ID Nos.: 335 and 336.

According to some embodiments, the gene targeted by the dsRNA is a nucleotide sequence encoding a Cut8 nuclear proteasome tether subunit related gene. According to some embodiments, the Cut8 nuclear proteasome tether related gene has a coding sequence selected from the group consisting of SEQ ID Nos.: 337-340.

According to some embodiments, the gene targeted by the dsRNA is a proteasome stabilizer related gene. According to some embodiments, the proteasome stabilizer related gene has a coding sequence selected from the group consisting of SEQ ID Nos.: 341-345.

According to some embodiments, the gene targeted by the dsRNA is a JAB1/Mov34/MPN/PAD-1 ubiquitin protease related gene. According to some embodiments, the JAB1/Mov34/MPN/PAD-1 ubiquitin protease related gene has a coding sequence selected from the group consisting of SEQ ID Nos.: 346-351.

According to some embodiments, the gene targeted by the dsRNA is a proteasome activator pa28 beta subunit related gene. According to some embodiments, the proteasome activator pa28 beta subunit related gene has a coding sequence set forth in SEQ ID NO.: 352.

According to some embodiments, the gene targeted by the dsRNA is a proteasome assembly chaperone 4 related gene. According to some embodiments, the proteasome assembly chaperone 4 related gene has a coding sequence set forth in SEQ ID NO: 353.

According to some embodiments, the gene targeted by the dsRNA is a PAC2 family member related gene. According to some embodiments, the PAC2 family member related gene has a coding sequence set forth in SEQ ID NO: 354.

According to some embodiments, the gene targeted by the dsRNA is a proteasome assembly chaperone 3 related gene. According to some embodiments, the proteasome assembly chaperone 3 related gene has a coding sequence selected from the group consisting of SEQ ID Nos.: 355-357.

According to some embodiments, the gene targeted by the dsRNA is a PI31 proteasome regulator. According to some embodiments, the PI31 proteasome regulator related gene has a coding sequence set forth in SEQ ID NO: 358-360.

According to some embodiments, the gene targeted by the dsRNA is a proteasome associated PITH domain containing related gene. According to some embodiments, the proteasome associated PITH domain related gene has a coding sequence selected from the group consisting of SEQ ID Nos.: 361-366.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 367-370.

According to some embodiments, the gene targeted by the dsRNA is a Proteasome complex subunit Rpn13 ubiquitin receptor related gene. According to some embodiments, the Proteasome complex subunit Rpn13 ubiquitin receptor related gene has a coding sequence set forth in SEQ ID NO: 371.

According to some embodiments, the gene targeted by the dsRNA is a nucleotide sequence encoding a proteasome-ubiquitin-receptor Rpn13 UCH-binding domain related gene. According to some embodiments, the proteasome-ubiquitin-receptor Rpn13 UCH-binding domain related gene has a coding sequence set forth in SEQ ID NO: 373.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 368-371.

According to some embodiments, the gene targeted by the dsRNA is a Tat binding protein 1 (TBP-1)-interacting protein (TBPIP) related gene. According to some embodiments, the nucleotide sequence encoding the TBPIP related gene has a coding sequence set forth in SEQ ID NO: 376.

According to some embodiments, the dsRNA has a polynucleotide sequence being about 90% to about 100% complementary to a segment of a target gene of the red palm weevil. According to some embodiments, the dsRNA has a polynucleotide sequence being about 95% to about 100% complementary to a segment of a target gene of the red palm weevil.

According to some embodiments, the host cell is a plant, plant cells, progeny plants of any generation, seeds, plant products and the like.

According to some embodiments, there is provided a method of producing a plant, or a commodity product thereof, transformed with a polynucleotide comprising a dsRNA having a polynucleotide sequence which is about 95% to about 100% complementary to a segment of a target gene of the pest, wherein ingestion of the dsRNA polynucleotide by the pest results in mortality and/or stunting thereof.

Non-limiting examples of suitable commodity products include meals, oils, crushed or whole grains or seeds of a plant, or any food product comprising any meal, oil, or crushed or whole grain of a recombinant plant or seed containing one or more of the sequences of the present invention.

According to some embodiments, there is provided a composition comprising a dsRNA having a polynucleotide sequence which is about 85% to about 100% complementary to a segment of a target gene of the pest, wherein ingestion of said dsRNA polynucleotide by said pest results in mortality and/or stunting thereof.

According to some embodiments, the pest may be a red palm weevil (*Rhynchophorus ferrugineus*).

According to some embodiments, the gene targeted by the dsRNA has a nucleotide sequence selected from the group consisting of SEQ ID Nos.: 1-314 and 335-376.

According to some embodiments, the gene targeted by the dsRNA has a nucleotide sequence selected from the group consisting of SEQ ID Nos.: 1-26.

According to some embodiments, the gene targeted by the dsRNA has a nucleotide sequence selected from the group consisting of SEQ ID Nos.: 1-6.

According to some embodiments, the gene targeted by the dsRNA has a nucleotide sequence selected from the group consisting of SEQ ID Nos.: 1-12, 14, 16-18, 20, 21, 24, 26, 335, 341-343, 346-348, 352-355, 359, 361, 362, 367 and 371-374.

According to some embodiments, the gene targeted by the dsRNA is a proteasomal complex related gene. According to some embodiments, the nucleotide sequence encoding the proteasomal complex related gene has a coding sequence selected from the group consisting of SEQ ID Nos.: 3, 6, 7, 8, 10, 20, 21 and 26.

According to some embodiments, the gene targeted by the dsRNA is a proteasomal alfa subunit related gene. According to some embodiments, the nucleotide sequence of the proteasomal alfa subunit gene has a coding sequence selected from the group consisting of SEQ ID Nos.: 7, 8, 47, 57, 63, 121, 124, 125, 252 and 272.

According to some embodiments, the gene targeted by the dsRNA is a proteasomal beta subunit related gene. According to some embodiments, the proteasomal beta subunit gene has a coding sequence selected from the group consisting of SEQ ID Nos.: 3, 10, 19, 20, 30, 55, 96 and 373-375.

According to some embodiments, the gene targeted by the dsRNA is a 26S proteasome subunit RPN7 related gene. According to some embodiments, the nucleotide sequence encoding the 26S proteasome subunit RPN7 has a nucleotide sequence selected from the group consisting of SEQ ID Nos.: 6, 21 and 26.

According to some embodiments, the gene targeted by the dsRNA is a proteasome-substrate-size regulator related gene. According to some embodiments, the proteasome-substrate-size regulator related gene has a coding sequence selected from the group consisting of SEQ ID Nos.: 335 and 336.

According to some embodiments, the gene targeted by the dsRNA is a nucleotide sequence encoding a Cut8 nuclear proteasome tether subunit related gene. According to some embodiments, the Cut8 nuclear proteasome tether related gene has a coding sequence selected from the group consisting of SEQ ID Nos.: 337-340.

According to some embodiments, the gene targeted by the dsRNA is a proteasome stabilizer related gene. According to some embodiments, the proteasome stabilizer related gene has a coding sequence selected from the group consisting of SEQ ID Nos.: 341-345.

According to some embodiments, the gene targeted by the dsRNA is a JAB1/Mov34/MPN/PAD-1 ubiquitin protease related gene. According to some embodiments, the JAB1/Mov34/MPN/PAD-1 ubiquitin protease related gene has a coding sequence selected from the group consisting of SEQ ID Nos.: 346-351.

According to some embodiments, the gene targeted by the dsRNA is a proteasome activator pa28 beta subunit related gene. According to some embodiments, the proteasome activator pa28 beta subunit related gene has a coding sequence set forth in SEQ ID NO.: 352.

According to some embodiments, the gene targeted by the dsRNA is a proteasome assembly chaperone 4 related gene. According to some embodiments, the proteasome assembly chaperone 4 related gene has a coding sequence set forth in SEQ ID NO: 353.

According to some embodiments, the gene targeted by the dsRNA is a PAC2 family member related gene. According to some embodiments, the PAC2 family member related gene has a coding sequence set forth in SEQ ID NO: 354.

According to some embodiments, the gene targeted by the dsRNA is a proteasome assembly chaperone 3 related gene. According to some embodiments, the proteasome assembly chaperone 3 related gene has a coding sequence selected from the group consisting of SEQ ID Nos.: 355-357.

According to some embodiments, the gene targeted by the dsRNA is a PI31 proteasome regulator. According to some embodiments, the PI31 proteasome regulator related gene has a coding sequence set forth in SEQ ID NO: 358-360.

According to some embodiments, the gene targeted by the dsRNA is a proteasome associated PITH domain containing related gene. According to some embodiments, the proteasome associated PITH domain related gene has a coding sequence selected from the group consisting of SEQ ID Nos.: 361-366.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 367-370.

According to some embodiments, the gene targeted by the dsRNA is a Proteasome complex subunit Rpn13 ubiquitin receptor related gene. According to some embodiments, the Proteasome complex subunit Rpn13 ubiquitin receptor related gene has a coding sequence set forth in SEQ ID NO: 371.

According to some embodiments, the gene targeted by the dsRNA is a nucleotide sequence encoding a proteasome-ubiquitin-receptor Rpn13 UCH-binding domain related gene. According to some embodiments, the proteasome-ubiquitin-receptor Rpn13 UCH-binding domain related gene has a coding sequence set forth in SEQ ID NO: 373.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 368-371.

According to some embodiments, the gene targeted by the dsRNA is a Tat binding protein 1 (TBP-1)-interacting protein (TBPIP) related gene. According to some embodiments, the nucleotide sequence encoding the TBPIP related gene has a coding sequence set forth in SEQ ID NO: 376.

According to some embodiments, the dsRNA has a polynucleotide sequence being about 90% to about 100% complementary to a segment of a target gene of the red palm weevil. According to some embodiments, the dsRNA has a polynucleotide sequence being about 95% to about 100% complementary to a segment of a target gene of the red palm weevil.

According to some embodiments, the composition may be in the form of a solid, liquid, powder, suspension, emulsion, spray, encapsulation, microbeads, carrier particulates, film, matrix, soil drench, or seed treatment.

According to some embodiments, the composition comprises nanoparticles and/or liposomes incorporating the dsRNA.

According to some embodiments, the composition further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator.

According to some embodiments, there is provided a method for controlling preventing, ameliorating and/or treating infestation of a plant with a pest, the method comprising providing to the plant and/or the pest a dsRNA having a polynucleotide sequence which is about 85% to about 100% complementary to a fragment of a target gene of the pest, wherein ingestion of the dsRNA polynucleotide by the pest results in mortality and/or stunting thereof.

According to some embodiments, there is provided a method for targeted killing of a red palm weevil (*Rhynchophorus ferrugineus*), the method comprising providing (administering, feeding, spraying) the red palm weevil with a dsRNA having a polynucleotide sequence which is about 85% to about 100% complementary to a fragment of a target gene red palm weevil, wherein providing of the dsRNA (e.g. as a result of ingestion) to the pest results in mortality and/or stunting thereof. According to some embodiments, the red palm weevil is a red palm weevil larvae.

According to some embodiments, the pest may be a red palm weevil (*Rhynchophorus ferrugineus*) and the dsRNA may be a dsRNA targeting a gene vital to the survival and/or propagation of the red palm weevil.

According to some embodiments, the gene targeted by the dsRNA has a nucleotide sequence selected from the group consisting of SEQ ID Nos.: 1-314 and 335-376.

According to some embodiments, the gene targeted by the dsRNA has a nucleotide sequence selected from the group consisting of SEQ ID Nos.: 1-26.

According to some embodiments, the gene targeted by the dsRNA has a nucleotide sequence selected from the group consisting of SEQ ID Nos.: 1-6.

According to some embodiments, the gene targeted by the dsRNA has a coding sequence selected from the group consisting of SEQ ID Nos.: 1-12, 14, 16-18, 20, 21, 24, 26, 335, 341-343, 346-348, 352-355, 359, 361, 362, 367 and 371-374.

According to some embodiments, the gene targeted by the dsRNA is a proteasomal complex related gene. According to some embodiments, the proteasomal complex related gene has a coding sequence selected from the group consisting of SEQ ID Nos.: 3, 6, 7, 8, 10, 20, 21 and 26.

According to some embodiments, the gene targeted by the dsRNA is a proteasomal alfa subunit related gene. According to some embodiments, the nucleotide sequence of the proteasomal alfa subunit gene has a coding sequence selected from the group consisting of SEQ ID Nos.: 7, 8, 47, 57, 63, 121, 124, 125, 252 and 272.

According to some embodiments, the gene targeted by the dsRNA is a proteasomal beta subunit related gene. According to some embodiments, the proteasomal beta subunit gene has a coding sequence selected from the group consisting of SEQ ID Nos.: 3, 10, 19, 20, 30, 55, 96 and 373-375.

According to some embodiments, the gene targeted by the dsRNA is a 26S proteasome subunit RPN7 related gene. According to some embodiments, the nucleotide sequence encoding the 26S proteasome subunit RPN7 has a nucleotide sequence selected from the group consisting of SEQ ID Nos.: 6, 21 and 26.

According to some embodiments, the gene targeted by the dsRNA is a proteasome-substrate-size regulator related gene. According to some embodiments, the proteasome-substrate-size regulator related gene has a coding sequence selected from the group consisting of SEQ ID Nos.: 335 and 336.

According to some embodiments, the gene targeted by the dsRNA is a nucleotide sequence encoding a Cut8 nuclear proteasome tether subunit related gene. According to some embodiments, the Cut8 nuclear proteasome tether related gene has a coding sequence selected from the group consisting of SEQ ID Nos.: 337-340.

According to some embodiments, the gene targeted by the dsRNA is a proteasome stabilizer related gene. According to some embodiments, the proteasome stabilizer related gene has a coding sequence selected from the group consisting of SEQ ID Nos.: 341-345.

According to some embodiments, the gene targeted by the dsRNA is a JAB1/Mov34/MPN/PAD-1 ubiquitin protease related gene. According to some embodiments, the JAB1/Mov34/MPN/PAD-1 ubiquitin protease related gene has a coding sequence selected from the group consisting of SEQ ID Nos.: 346-351.

According to some embodiments, the gene targeted by the dsRNA is a proteasome activator pa28 beta subunit related gene. According to some embodiments, the proteasome activator pa28 beta subunit related gene has a coding sequence set forth in SEQ ID NO.: 352.

According to some embodiments, the gene targeted by the dsRNA is a proteasome assembly chaperone 4 related gene. According to some embodiments, the proteasome assembly chaperone 4 related gene has a coding sequence set forth in SEQ ID NO: 353.

According to some embodiments, the gene targeted by the dsRNA is a PAC2 family member related gene. According to some embodiments, the PAC2 family member related gene has a coding sequence set forth in SEQ ID NO: 354.

According to some embodiments, the gene targeted by the dsRNA is a proteasome assembly chaperone 3 related gene. According to some embodiments, the proteasome assembly chaperone 3 related gene has a coding sequence selected from the group consisting of SEQ ID Nos.: 355-357.

According to some embodiments, the gene targeted by the dsRNA is a PI31 proteasome regulator. According to some embodiments, the PI31 proteasome regulator related gene has a coding sequence set forth in SEQ ID NO: 358-360.

According to some embodiments, the gene targeted by the dsRNA is a proteasome associated PITH domain containing related gene. According to some embodiments, the proteasome associated PITH domain related gene has a coding sequence selected from the group consisting of SEQ ID Nos.: 361-366.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 367-370.

Proteasome complex subunit Rpn13 ubiquitin receptor related gene. According to some embodiments, the Proteasome complex subunit Rpn13 ubiquitin receptor related gene has a coding sequence set forth in SEQ ID NO: 371.

According to some embodiments, the gene targeted by the dsRNA is a nucleotide sequence encoding a proteasome-ubiquitin-receptor Rpn13 UCH-binding domain related gene. According to some embodiments, the proteasome-ubiquitin-receptor Rpn13 UCH-binding domain related gene has a coding sequence set forth in SEQ ID NO: 373.

According to some embodiments, the gene targeted by the dsRNA is a Proteasome non-ATPase 26S subunit related gene. According to some embodiments, the Proteasome non-ATPase 26S subunit related gene has a coding sequence selected from the group consisting of SEQ ID Nos.: 368-371.

According to some embodiments, the gene targeted by the dsRNA is a Tat binding protein 1 (TBP-1)-interacting protein (TBPIP) related gene. According to some embodiments, the nucleotide sequence encoding the TBPIP related gene has a coding sequence set forth in SEQ ID NO: 376.

According to some embodiments, the dsRNA has a polynucleotide sequence being about 90% to about 100% complementary to a segment of a target gene of the red palm weevil. According to some embodiments, the dsRNA has a polynucleotide sequence being about 95% to about 100% complementary to a segment of a target gene of the red palm weevil.

According to some embodiments, the providing of the dsRNA to the plant comprises applying the dsRNA or a composition comprising same on the plant; injecting the dsRNA or a composition comprising same into the plant; delivering the composition to the plant by absorption through the soil; placing food/feed comprising the dsRNA in proximity to the plant or the pest; expressing the dsRNA endogenously in the plant, applying a composition comprising bacteria expressing the dsRNA on the plant or any combination thereof.

Certain embodiments of the present disclosure may include some, all, or none of the above advantages. One or more technical advantages may be readily apparent to those skilled in the art from the figures, descriptions and claims included herein. Moreover, while specific advantages have been enumerated above, various embodiments may include all, some or none of the enumerated advantages.

In addition to the exemplary aspects and embodiments described above, further aspects and embodiments will become apparent by reference to the figures and by study of the following detailed descriptions.

BRIEF DESCRIPTION OF THE FIGURES

The invention will now be described in relation to certain examples and embodiments with reference to the following illustrative figures so that it may be more fully understood.

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The present invention provides dsRNAs, compositions comprising same and methods of using dsRNA for genetic control of pest infestations. Specifically, the present invention relates to sequence-specific inhibition of expression of coding sequences using double-stranded RNA (dsRNA), including small interfering RNA (siRNA), to achieve the intended levels of pest control.

As used herein, the term "infestation" refers to a plant being invaded by a parasite or pest, such as, but not limited to, a palm tree being invaded by a red palm weevil. According to some embodiments, the severity of an infestation may be evaluated by a degree of damage caused to the infested plant, such as by observation of yellowing of the tree, wilting of the leaves of the tree, crown loss, death of the tree. According to some embodiments, the severity of an infestation may be evaluated by drilling into the stem tree or by cutting of the stem. According to some embodiments, the severity of an infestation may be evaluated by bioacoustics analysis.

The inventors have herein discovered that, feeding dsRNA (or a composition containing same) including sequences found within one or more expressed nucleotide sequences of a pest, specifically of the red palm weevil, results in the inhibition of one or more biological functions within the pest. Particularly, the inventors have discovered that feeding the dsRNA molecules targeting one or more of SEQ ID NO: 1-314 and 335-376, each possibility is a separate embodiment, to plant pest such as the red palm weevil, results in the death or inhibition of development and differentiation of the pest that ingests these compositions.

It has further been found that nucleotide sequences, which, when transcribed, forms a dsRNA complementary to a sequence derived from the red palm weevil, can be used to generate plants, resistant to infestation by the pest. This facilitates making the dsRNA available in the diet of the pest if/when the pest feeds upon the transgenic host or upon food/feed/bait comprising the dsRNA, resulting in the suppression of expression of one or more genes in the cells of the pest and ultimately the death, stunting, or other inhibition of the pest.

According to some embodiments, the dsRNA molecules may be introduced into nutritional compositions that the pest relies on as a food source, thus making the nutritional composition available to the pest for feeding. Ingestion of the nutritional composition containing the double stranded or siRNA molecules results in the uptake of the molecules by the cells of the pest, resulting in the inhibition of expression of at least one target gene in the cells of the pest. Inhibition of the target gene exerts a deleterious effect upon the pest. According to some embodiments, the target gene is highly selective to the specific pest, such that upon ingestion, the double stranded or siRNA molecules are deleterious to the specific pest, while other organisms, including humans are safe.

According to some embodiments, the dsRNA includes a polynucleotide sequence which is about 95% to about 100% complementary to at least a segment of a target gene of the pest, such that ingestion of the dsRNA by the pest results in mortality and/or stunting thereof.

According to some embodiments, the pest may be a red palm weevil (*Rhynchophorus ferrugineus*).

According to some embodiments, the gene targeted for suppression can encode an essential protein. Non-limiting examples of suitable function of the essential protein include muscle formation, juvenile hormone formation, juvenile hormone regulation, ion regulation and transport, protein synthesis, transport and degradation, digestive enzyme synthesis, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, an unknown function, and apoptosis. Each possibility is a separate embodiment.

According to some embodiments, the target gene may be a gene expressed in the gut of the pest.

According to some embodiments, the dsRNA inhibits a nucleotide sequence (mRNA) selected from the group consisting of the SEQ ID Nos.: 1-314 and 335-376. Each possibility is a separate embodiment. According to some embodiments, the dsRNA comprises a nucleotide sequence complementary to at least a segment of a nucleotide sequence (mRNA) within the cells of the pest, such as any of nucleotide sequences set forth in SEQ ID Nos.: 315-319 and 321-334 producing the dsRNAs. Each possibility is a separate embodiment.

As a non-limiting example, the dsRNA comprises a nucleotide sequence complementary to at least a segment of the RNAs set forth in SEQ ID NO: 1. As another non-limiting example, the dsRNA comprises a nucleotide sequence complementary to at least a segment of the RNAs set forth in SEQ ID NO: 2. As another non-limiting example, the dsRNA comprises a nucleotide sequence complementary to at least a segment of the RNAs set forth in SEQ ID NO: 3. As another non-limiting example, the dsRNA comprises a nucleotide sequence complementary to at least a segment of the RNAs set forth in SEQ ID NO: 4. As another non-limiting example, the dsRNA comprises a nucleotide sequence complementary to at least a segment of the RNAs set forth in SEQ ID NO: 5. As another non-limiting example, the dsRNA comprises a nucleotide sequence complementary to at least a segment of the RNAs set forth in SEQ ID NO: 6. As another non-limiting example, the dsRNA comprises a nucleotide sequence complementary to at least a segment of the RNAs set forth in SEQ ID NO: 7. As another non-limiting example, the dsRNA comprises a nucleotide sequence complementary to at least a segment of the RNAs set forth in SEQ ID NO: 8. As another non-limiting example, the dsRNA comprises a nucleotide sequence complementary to at least a segment of the RNAs set forth in SEQ ID NO: 9. As another non-limiting example, the dsRNA comprises a nucleotide sequence complementary to at least a segment of the RNAs set forth in SEQ ID NO: 10. As another non-limiting example, the dsRNA comprises a nucleotide sequence complementary to at least a segment of the RNAs set forth in SEQ ID NO: 11. As another non-limiting example, the dsRNA comprises a nucleotide sequence complementary to at least a segment of the RNAs set forth in SEQ ID NO: 12. As another non-limiting example, the dsRNA comprises a nucleotide sequence complementary to at least a segment of the RNAs set forth in SEQ ID NO: 13. As another non-limiting example, the dsRNA comprises a nucleotide sequence complementary to at least a segment of the RNAs set forth in SEQ ID NO: 14. As another non-limiting example, the dsRNA comprises a nucleotide sequence complementary to at least a segment of the RNAs set forth in SEQ ID NO: 15. As another non-limiting example, the dsRNA comprises a nucleotide sequence complementary to at least a segment of the RNAs set forth in SEQ ID NO: 16. As another non-limiting example, the dsRNA comprises a nucleotide sequence complementary to at least a segment of the RNAs set forth in SEQ ID NO: 17. As another non-limiting example, the dsRNA comprises a nucleotide sequence complementary to at least a segment of the RNAs set forth in SEQ ID NO: 18. As another non-limiting example, the dsRNA comprises a nucleotide sequence complementary to at least a segment of the RNAs set forth in SEQ ID NO: 19. As another non-limiting example, the dsRNA comprises a nucleotide sequence complementary to at least a segment of the RNAs set forth in SEQ ID NO: 20. As another non-limiting example, the dsRNA comprises a nucleotide sequence complementary to at least a segment of the RNAs set forth in SEQ ID NO: 21. As another non-limiting example, the dsRNA comprises a nucleotide sequence complementary to at least a segment of the RNAs set forth in SEQ ID NO: 22. As another non-limiting example, the dsRNA comprises a nucleotide sequence complementary to at least a segment of the RNAs set forth in SEQ ID NO: 23. As another non-limiting example, the dsRNA comprises a nucleotide sequence complementary to at least a segment of the RNAs set forth in SEQ ID NO: 24. As another non-limiting example, the dsRNA comprises a nucleotide sequence complementary to at least a segment of the RNAs set forth in SEQ ID NO: 25. As another non-limiting example, the dsRNA comprises a nucleotide sequence complementary to at least a segment of the RNAs set forth in SEQ ID NO: 26.

According to some embodiments, the dsRNA may be a short hairpin RNA (shRNA), a small interfering RNAs (siRNAs), or an miRNA. Each possibility is a separate embodiment.

According to some embodiments, the dsRNA, may include at least two coding sequences, or/and untranslated regions (UTRs) that are arranged in a sense and an antisense orientation relative to at least one promoter, wherein the nucleotide sequence that comprises a sense strand and an antisense strand are linked or connected by a spacer sequence of at least from about five to about one thousand nucleotides.

According to some embodiments, the dsRNA may be an shRNA of at least 100 bp which subsequently, either within the host cell or when ingested by the pest, becomes digested into siRNA.

According to some embodiments, the dsRNA may be an siRNA including about 19 to about 23 nucleotides.

According to some embodiments, the dsRNA is an shRNA comprising about 23 to about 500 nucleotides, about 100 to about 2000 nucleotides, 140 to about 400 nucleotides or any other suitable number of nucleotides between 23 and 2000 nucleotides. According to some embodiments, the dsRNA comprises at least 140 bp. According to some embodiments, the dsRNA comprises at least 200 bp. According to some embodiments, the complementary segment of the dsRNA may include about at least 19, 21, 23, 25, 40, 60, 80, 100, 125, 140, 200, 250, 300 or more contiguous nucleotides derived from or complementary to one or more of the sequences in SEQ ID Nos.: 1-314 and 335-376. Each possibility is a separate embodiment.

According to some embodiments, the complementary segment of the dsRNA may have at least from about 80, 81, 82, 83, 84, 85, 86, 87, 88 89, 90, 91, 92, 93, 94, 95, 96, 97, 98, 99, or about 100% complementarity to a segment of at least one of the nucleotide sequence selected from the group consisting of SEQ ID Nos.: 1-314 and 335-376. Each possibility is a separate embodiment. According to some embodiments, a segment of the at least one nucleotide sequence does not include the poly-A tail of the nucleotide sequence.

According to some embodiments, the dsRNA may have a sense strand set forth in any one of SEQ ID Nos: 315-319 and 321 below. According to some embodiments, the T (thymidine) set forth in the sequence listing of the dsRNA may be replaced with a U, representing Uracil.

For example, the dsRNA sequences can be expressed as a hairpin and stem and loop structure by taking a first segment corresponding to a segment of a sequence selected from SEQ ID NO:1-314 and 335-376, such as a sequence selected from SEQ ID NO: 315-319 and 321, linking this sequence to a second segment which is a spacer region that is not homologous or complementary to the first segment, and linking this to a third segment that transcribes an RNA, at least a portion of which is substantially complementary to the first segment. Such a construct forms a stem and loop structure by hybridization of the first segment with the third segment and a loop structure form comprising the second segment.

According to some embodiments, the spacer sequence may be a region comprising any sequence of nucleotides that facilitates secondary structure formation between each repeat, where this is required. The spacer sequence may alternatively comprise any combination of nucleotides or homologues thereof that are capable of being linked covalently to a nucleic acid molecule. The spacer sequence may comprise a sequence of nucleotides of at least about 10-100 nucleotides in length, or alternatively at least about 100-200 nucleotides in length, at least 200-400 about nucleotides in length, or at least about 400-500 nucleotides in length. Each possibility is a separate embodiment.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The terms "nucleotide sequence" and "nucleic acid sequence" may be used interchangeably and refer to both the sense and antisense strands of a nucleic acid as either individual single strands or in the duplex. According to some embodiments, the term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA). According to some embodiments, the term RNA with referral to the target gene, may refer to the mRNA of the target gene. According to some embodiments, the term "deoxyribonucleic-acid" (DNA) is inclusive of cDNA and genomic DNA and DNA-RNA hybrids.

The term "nucleic acid segment", "nucleotide sequence segment", or more generally "segment" may include both genomic sequences, ribosomal RNA sequences, transfer RNA sequences, messenger RNA sequences, operon sequences and smaller engineered nucleotide sequences that express or may be adapted to express, proteins, polypeptides or peptides. According to some embodiments, the term "segment" may refer to part of DNA/RNA encoding a gene, such as a part of any of the nucleotide sequences (mRNA), set forth in SEQ ID NO: 1-314 and 335-376.

As used herein, the term "substantially homologous" or "substantial homology", with reference to a nucleic acid sequence, includes a nucleotide sequence that hybridizes under stringent conditions to the coding sequence as set forth in any of SEQ ID NO:1-314 and 335-376, or the complements thereof. Sequences that hybridize under stringent conditions to any of SEQ ID NO:1-314 and 335-376, or the complements thereof, are those that allow an antiparallel alignment to take place between the two sequences, and the two sequences are then able, under stringent conditions, to form hydrogen bonds with corresponding bases on the opposite strand to form a duplex molecule that is sufficiently stable under the stringent conditions to be detectable using methods well known in the art. Substantially homologous sequences have preferably from about 70% to about 80% sequence identity, or more preferably from about 80% to about 85% sequence identity, or most preferable from about 90% to about 95% sequence identity, to about 99% sequence identity, to the referent nucleotide sequences as set forth in any of SEQ ID NO:1-314 and 335-376, as set forth in the sequence listing, or the complements thereof. Departures from complete complementarity are permissible, as long as such departures do not completely preclude the capacity of the molecules to form a double-stranded structure.

As used herein, the term "sequence identity", "sequence similarity" or "homology" is used to describe sequence relationships between two or more nucleotide sequences. The percentage of "sequence identity" between two sequences is determined by comparing two optimally aligned sequences. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, the term "proteasome" refers to any complex or protein which degrade proteins by proteolysis in cells. In structure, the proteasome is a cylindrical complex containing a "core" of four stacked rings forming a central pore. Each ring is composed of seven individual proteins. The inner two rings are made of seven beta subunits that contain three to seven protease active sites. The outer two rings each contain seven alpha subunits whose function is to maintain a "gate" through which proteins enter the barrel. The alpha subunits are controlled by binding to "cap" structures or regulatory particles that recognize polyubiquitin tags attached to protein substrates and initiate the degradation process. The overall system of ubiquitination and proteasomal degradation is known as the ubiquitin-proteasome system.

As used herein, the terms "proteasomal complex", "proteasomal protein" and "proteasome associated protein" refer to any complex or protein being part of or associated with the ubiquitin-proteasome system.

According to some embodiments, the nucleotide sequences set forth in SEQ ID Nos: 3, 6, 7, 8, 10, 19-21, 21, 26, 30, 47, 55, 57, 63 and 335-376 are herein referred to as sequences encoding for proteasomal proteins or proteasome-associated proteins.

The sequence of the nucleotide encoding the dsRNA can be constructed from a sequence that functions in the suppression of a single gene or gene family in the one or more target pests, or that the DNA sequence can be constructed as a chimera from a plurality of DNA sequences.

According to some embodiments, the present invention provides recombinant DNA technologies to post-transcriptionally repress or inhibit expression of a target gene in the cell of a pest to provide a pest-protective effect, for example, by feeding to the pest one or more double stranded or small interfering ribonucleic acid (RNA) molecules transcribed from all or a portion of a target coding sequence, thereby controlling the infestation. According to some embodiments, the recombinant DNA encodes transcription of the herein disclosed dsRNA. According to some embodiments, the DNA may be introduced into the genome of a host cell, such as, but not limited to, the plant for which protection is sought or host cells that can be delivered to the plant as a feed/bait for the pest.

According to some embodiments, transgenic plants that (a) contain nucleotide sequences encoding the synthetic or non-naturally occurring recombinant DNA constructs for transcribing the dsRNA molecules for controlling plant pest infestations, and (b) display resistance and/or enhanced tolerance to the insect infestations, are provided herein.

Compositions containing the dsRNA nucleotide sequences of the present invention for use in topical applications onto plants or onto animals or into the environment of an animal to achieve the elimination or reduction of pest infestation are also described.

A recombinant DNA vector may, for example, be a linear or a closed circular plasmid. The vector system may be a single vector or plasmid or two or more vectors or plasmids that together contain the total DNA to be introduced into the genome of the bacterial host. In addition, a bacterial vector may be an expression vector. Nucleic acid molecules as set forth in SEQ ID NO: 315-319 and 321-334 can, for example, be inserted into a vector under the control of a suitable promoter that functions in the hosts to drive expression. Many vectors are available for this purpose, and selection of the appropriate vector will depend mainly on the size of the nucleic acid to be inserted into the vector and the particular host cell to be transformed with the vector. Each vector contains various components depending on its function and the particular host cell with which it is compatible.

A transformation vector may contain sequences from more than one gene, thus allowing production of more than one dsRNA for inhibiting expression of two or more genes in cells of a target pest. According to some embodiment, segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments e.g. between the enhancer and promoter and terminator sequences.

According to some embodiments, the host cell is a plant, plant cells, progeny plants of any generation, seeds, plant products and the like. Each possibility is a separate embodiment.

Methods for the creation of transgenic plants and expression of heterologous nucleic acids in plants, in particular, are known and may be used with the nucleic acids provided herein to prepare transgenic plants that exhibit reduced susceptibility to feeding by a target pest organism, such as red palm weevil. Plant transformation vectors can be prepared, for example, by inserting or cloning the dsRNA producing nucleic acids disclosed herein into plant transformation vectors and introducing these into plants. One known vector system has been derived by modifying the natural gene transfer system of *Agrobacterium tumefaciens*.

A transgenic plant formed using *Agrobacterium* transformation methods typically contains a single simple recombinant DNA sequence inserted into one chromosome and is referred to as a transgenic event. Such transgenic plants can be referred to as being heterozygous for the inserted exogenous sequence. A transgenic plant homozygous with respect to a transgene can be obtained by selfing an independent segregant transgenic plant to produce an F1 seed. One fourth of the F1 seed produced will be homozygous with respect to the transgene. Germinating an F1 seed results in plants that can be tested for heterozygosity or homozygosity, for example using a SNP assay or a thermal amplification assay that allows for the distinction between heterozygotes and homozygotes (i.e., a zygosity assay).

According to some embodiments, the plant may be any monocot and dicot plant. According to some embodiments, the plant may be palm trees. Non-limiting examples of palm trees from the Arecaceae family include, coconut palm (*Cocos nucifera*), oil palm (*Elaeis guineensis*), *Areca catechu, Arenga pinnata, Borassus flabellifer, Calamus merillii, Cargota maxima, Cargota cumingii, Corypha gebanga, Corypha elata, Livistona decipiens, Metroxglon sagu, Oreodoxa regia, Phoenix sylvestris, Phoenix canariensis, Phoenix dactylifera* (Date palm), *Sabal umbraculifera, Trachycarpus fortunei, Washingtonia* spp., and other palm like plants such as *Agave americana, Saccharum officinarum*, and *Chamaerops humilis* (known as Mediterranean dwarf Palm). Non-limiting examples of suitable plants include alfalfa, aneth, apple, apricot, artichoke, arugula, asparagus, avocado, banana, barley, beans, beet, blackberry, blueberry, broccoli, brussel sprouts, cabbage, canola, cantaloupe, carrot, cassava, cauliflower, celery, cherry, cilantro, citrus, clementine, coffee, corn, cotton, cucumber, Douglas fir, eggplant, endive, escarole, *eucalyptus*, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, palm trees. *papaya*, parsley, pea, peach, peanut, pear, pepper, persimmon, pine, pineapple, plantain, plum, pomegranate, poplar, potato, pumpkin, quince, *radiata* pine, radicchio, radish, raspberry, rice, rye, sorghum, Southern pine, soybean, spinach, squash, strawberry, sugarbeet, sugarcane, sunflower, sweet potato, sweetgum, tangerine, tea, tobacco, tomato, turf, a vine, watermelon, wheat, yams, and zucchini plants. Each possibility is a separate embodiment.

According to some embodiments, the palm tree is selected from *Phoenix dactylifera*

According to some embodiments, the host cell may be non-pathogenic or attenuated strains of microorganisms, e.g. bacteria, that may be used as a carrier for the insect control agents. The microorganisms may be engineered to express a nucleotide sequence of a target gene to produce RNA molecules comprising RNA sequences homologous or complementary to RNA sequences typically found within the cells of an insect. According to some embodiments, the microorganisms may serve as a vector or carrier of the dsRNA and may, for example, be sprayed on the plant, provided to the soil in proximity of the plant or be added to food/feed/bait provided on or in proximity to the plant. Exposure of the insects to the microorganisms result in ingestion of the microorganisms and down-regulation of expression of target genes mediated directly or indirectly by the RNA molecules or fragments or derivatives thereof.

According to some embodiments, the host cell may be any of a wide variety of prokaryotic and eukaryotic microorganism hosts. The term "microorganism" includes prokaryotic and eukaryotic microbial species such as bacteria, fungi and algae. Fungi include yeasts and filamentous fungi, among others. Illustrative prokaryotes, both Gram-negative and Gram-positive, include Enterobacteriaceae, such as *Escherichia, Shigella, Salmonella*, and *Proteus; Bacillaceae; Rhizobiceae*, such as *Rhizobium; Spirillaceae*, such as photobacterium, *Zymomonas, Serratia, Aeromonas, Vibrio, Desulfovibrio, Spirillum; Lactobacillaceae; Pseudomonadaceae*, such as *Pseudomonas* and *Acetobacter; Azotobacteraceae, Actinomycetales*, and *Nitrobacteraceae*. Among eukaryotes are fungi, such as *Phycomycetes* and *Ascomycetes*, which includes yeast, such as *Saccharomyces* and *Schizosaccharomyces*; and *Basidiomycetes*, such as *Rhodotorula, Aureobasidium, Sporobolomyces*, and the like. Each possibility is a separate embodiment.

According to some embodiments, the microorganism may be known to inhabit the plants stems or trunks, the phylloplane (the surface of the plant leaves) and/or the rhizosphere (the soil surrounding plant roots) of plants. Non-limiting examples of such microorganisms include bacteria, algae, and fungi. Of particular interest are microorganisms, such as bacteria, e.g., genera *Bacillus* (including the species and subspecies *B. thuringiensis* kurstaki HD-1, *B. thuringiensis* kurstaki HD-73, *B. thuringiensis* sotto, *B. thuringiensis* berliner, *B. thuringiensis thuringiensis, B. thuringiensis* tolworthi, *B. thuringiensis dendrolimus, B. thuringiensis* alesti, *B. thuringiensis* galleriae, *B. thuringiensis aizawai, B. thuringiensis* subtoxicus, *B. thuringiensis* entomocidus, *B. thuringiensis* tenebrionis and *B. thuringiensis* san diego); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc*, and *Alcaligenes*; fungi, particularly yeast, e.g., genera *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum, Agrobacterium tumefaciens, Rhodobacter sphaeroides, Xanthomonas campestris, Rhizobium melioti, Alcaligenes eutrophus*, and *Azotobacter vinlandii*; and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Each possibility is a separate embodiment.

Non-limiting examples of suitable bacterial hosts which may be used to produce insect control dsRNAs include *E. coli, Bacillus* sp. (e.g. *B. thuringiensis*), *Pseudomonas* sp., *Photorhabdus* sp., *Xenorhabdus* sp., *Serratia entomophila* and related *Serratia* sp., *B. sphaericus, B. cereus, B. laterosporus, B. popilliae, Clostridium bifermentans* and other *Clostridium* species, or other spore-forming gram-positive bacteria. Each possibility is a separate embodiment.

According to some embodiments, the dsRNA, as disclosed herein, may be incorporated in a spray mixer and applied to the surface of a host, such as a host plant. Without being bound by any theory, ingestion of the dsRNA by an insect delivers the dsRNA to the gut of the insect and subsequently to the cells within the body of the insect. In another embodiment, infection of the insect by the dsRNA through other means, such as by injection or other physical methods also permits delivery of the dsRNA. In yet another embodiment, the dsRNA molecules may be directly applied on the plant or be encapsulated and applied to the surface of the plant. Ingestion of the plant by the insect then permits delivery of the dsRNA to the insect and results in down-regulation of a target gene in the host.

Methods for oral introduction may include direct mixing of RNA with food of the insect, as well as engineered approaches in which a species that is used as food is engineered to express the dsRNA or siRNA, then fed to the insect to be affected. In one embodiment, for example, the dsRNA or siRNA molecules may be incorporated into, or overlaid on top of, the insect's diet. In another embodiment, the RNA may be sprayed onto a plant surface. In still another embodiment, the dsRNA or siRNA may be expressed by microorganisms and the microorganisms may be applied onto a plant surface or introduced into a root, stem or trunk by a physical means such as an injection. In still another embodiment, a plant may be genetically engineered to express the dsRNA or siRNA in an amount sufficient to kill the insects known to infect the plant.

According to some embodiments, the dsRNA may be exogenously applied onto the plant or its surroundings (e.g. soil).

According to some embodiments, the dsRNA may be exogenously applied through root absorption or injection into plant vessels, where these insects can naturally acquire dsRNA through sucking or chewing. According to some embodiments, the dsRNA may be supplied through irrigation. According to some embodiments, the dsRNA may be sprayed on the leaves and/or the trunk of the plant.

According to some embodiments, the dsRNA may control larvae and adult pests. According to some embodiments, the dsRNA may kill the adult pests before mating and/or before females have a chance to lay eggs.

The efficiency of RNAi is mainly driven by the delivery/uptake of intact dsRNA into cells and thus depends on the delivery vehicle that delivers the exogenous RNA safely and effectively to a target cell.

According to some embodiments, the composition comprises nanoparticles incorporating the dsRNA. Nanoparticles can be used to reduce dsRNA degradation and to increase the cellular uptake of intact dsRNA. Polymeric nanoparticles may be produced using natural and synthetic polymers. These may be used because of their stability, ease for surface modification, as well as their biodegradability and environmental safety. According to some embodiments, the polymer may be chitosan. Chitosan nanoparticles may be designed to self-accumulate with dsRNA via electrostatic forces among positive and negative charges of the amino groups in the chitosan and phosphate groups on the backbone of the nucleic acid, respectively. This method may be suitable with long dsRNA as well as siRNAs. According to some embodiments, the chitosan nanoparticles may then be mixed with the diet and be conveyed by oral ingestion.

According to some embodiments, the composition comprises liposomes incorporating the dsRNA. Liposomes are composed of natural lipids and they are non-toxic and easily biodegradable.

According to some embodiments, the dsRNA may be chemically modified on one or both strands to improve stability, expand the half-life of the dsRNA in-vivo, increase the bio-distribution and pharmacokinetic properties of the dsRNA, target the dsRNA to specific cells, increase the target binding affinity, and/or improve drug delivery. As a non-limiting example, the dsRNA may be modified to include methyl-groups to the 2' position of the ribosyl ring of the 2nd base of the dsRNA. As another non-limiting example, the dsRNA may be modified to include a 3' overhang.

According to some embodiments, the modifications can be included in the dsRNA. According to some embodiments, the modification does not prevent the dsRNA composition from serving as a substrate for Dicer. In one embodiment, one or more modifications are made that enhance Dicer processing of the dsRNA. In a second embodiment, one or more modifications are made that result in more effective RNAi generation. In a third embodiment, one or more modifications are made that support a greater RNAi effect. In a fourth embodiment, one or more modifications are made that result in greater potency per each dsRNA molecule to be delivered to the cell. Modifications can be incorporated in the 3'-terminal region, the 5'-terminal region, in both the 3'-terminal and 5'-terminal region or in some instances in various positions within the sequence. With the restrictions noted above in mind, any number and combination of modifications can be incorporated into the dsRNA. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied.

The following examples are presented in order to more fully illustrate some embodiments of the invention. They should, in no way be construed, however, as limiting the broad scope of the invention. One skilled in the art can readily devise many variations and modifications of the principles disclosed herein without departing from the scope of the invention.

EXAMPLES

Example 1—Feeding Experiment on 2-4 cm Red Palm Weevil Larvae

Larvae 2-4 cm long were grown separately (according to size) in a plastic, cup-like container and fed on crushed sugar cane stems.

1 ml of synthesized dsRNA molecules (Eupheria Biotech GmbH, Tatzberg 47-51, 01307 Dresden, Germany) of each of the sequences were dissolved 1 µg/ml in ddH2O and subsequently added to the sugar cane in a total of 2 micrograms per red palm weevil larvae treatment and repeated 5 times for each compound.

The containers were then placed in a dark humid location at a temperature of 25-30° C. The viability (dead=D, alive=A, not responsive=NR, slow=S) and change in mobility of the larvae was evaluated 3 times weekly (every 2-3 days), during 14 days following the treatment.

The results obtained for 7 different dsRNA compounds, targeting the RNA of the indicated SEQ ID NO. are shown in Table 1. Compound G is a 300 bp dsRNA of green fluorescent protein, GFP, that was used as a negative control. The sequence of the sense strand of the control RNA G is set forth in SEQ ID NO: 321, As seen from the table, several of the dsRNA caused death of larvae of all sizes, while others were particularly advantageous for the larger larvae. Similarly, some of the dsRNA proved to exert a deleterious effect on the larvae within a week, whereas others proved effective only more than a week after the treatment.

TABLE 1

Red palm weevil viability/motility

| Days post treatment (dpt) | SEQ ID NO. of target RNA | Larvae size | | | | |
|---|---|---|---|---|---|---|
| | | ~4 cm | ~4 cm | ~3 cm | ~2 cm | ~2 cm |
| | | | | Viability | | |
| 3 | 6 | A | A | A | A | A |
| 7 | 6 | A | A | A | A | NR |
| 11 | 6 | A | D | D | A | D |
| 14 | 6 | S | D | D | A | D |
| 3 | 4 | A | A | A | A | A |
| 7 | 4 | A | S | A | A | A |
| 11 | 4 | A | D | A | D | A |
| 14 | 4 | D | D | D | D | A |
| 3 | 2 | A | A | A | A | A |
| 7 | 2 | A | A | A | A | A |
| 11 | 2 | A | A | D | A | A |
| 14 | 2 | S | D | D | A | A |
| 3 | G | A | A | D | A | A |
| 7 | G | A | A | D | A | A |
| 11 | G | A | A | D | A | A |
| 14 | G | A | A | D | A | A |
| 3 | 3 | A | A | A | A | A |
| 7 | 3 | A | A | NR | D | NR |
| 11 | 3 | D | A | D | D | D |
| 14 | 3 | D | A | D | D | D |
| 3 | 1 | A | A | A | A | A |
| 7 | 1 | A | A | A | A | A |
| 11 | 1 | D | A | A | A | A |
| 14 | 1 | D | A | D | A | D |
| 3 | 5 | A | A | A | A | A |
| 7 | 5 | A | A | S | A | S |
| 11 | 5 | A | D | S | A | D |
| 14 | 5 | A | D | D | D | D |

Example 2—Feeding Experiment on 1-2.5 cm Red Palm Weevil Larvae 1-2.5 cm larvae were grown in a plastic cup-like container and fed on crushed sugar cane stem, as above.

1 ml of synthesized dsRNA molecules (Eupheria Biotech GmbH, Tatzberg 47-51, 01307 Dresden, Germany) of each of the indicated sequences (SEQ ID NO: 317—targeting SEQ ID the sequence set forth in SEQ ID NO: 3, 332—targeting SEQ ID the sequence set forth in SEQ ID NO: 8, 323—targeting SEQ ID the sequence set forth in SEQ ID NO: 7, 320—targeting SEQ ID the sequence set forth in SEQ ID NO: 6 and 333—targeting SEQ ID the sequence set forth in SEQ ID NO: 20, as well as the control dsRNA (wherein U is replaced by T)) were dissolved in ddH2O and subsequently added to the sugar cane in a total of 1 microgram per red palm weevil larvae treatment and repeated 5 times for each concentration.

The containers were then placed in a dark humid location at a temperature of 25-30° C. The viability and change in mobility of the larvae was evaluated 3 times weekly (every 2-3 days), for 14 days following the treatment.

Figure 1:
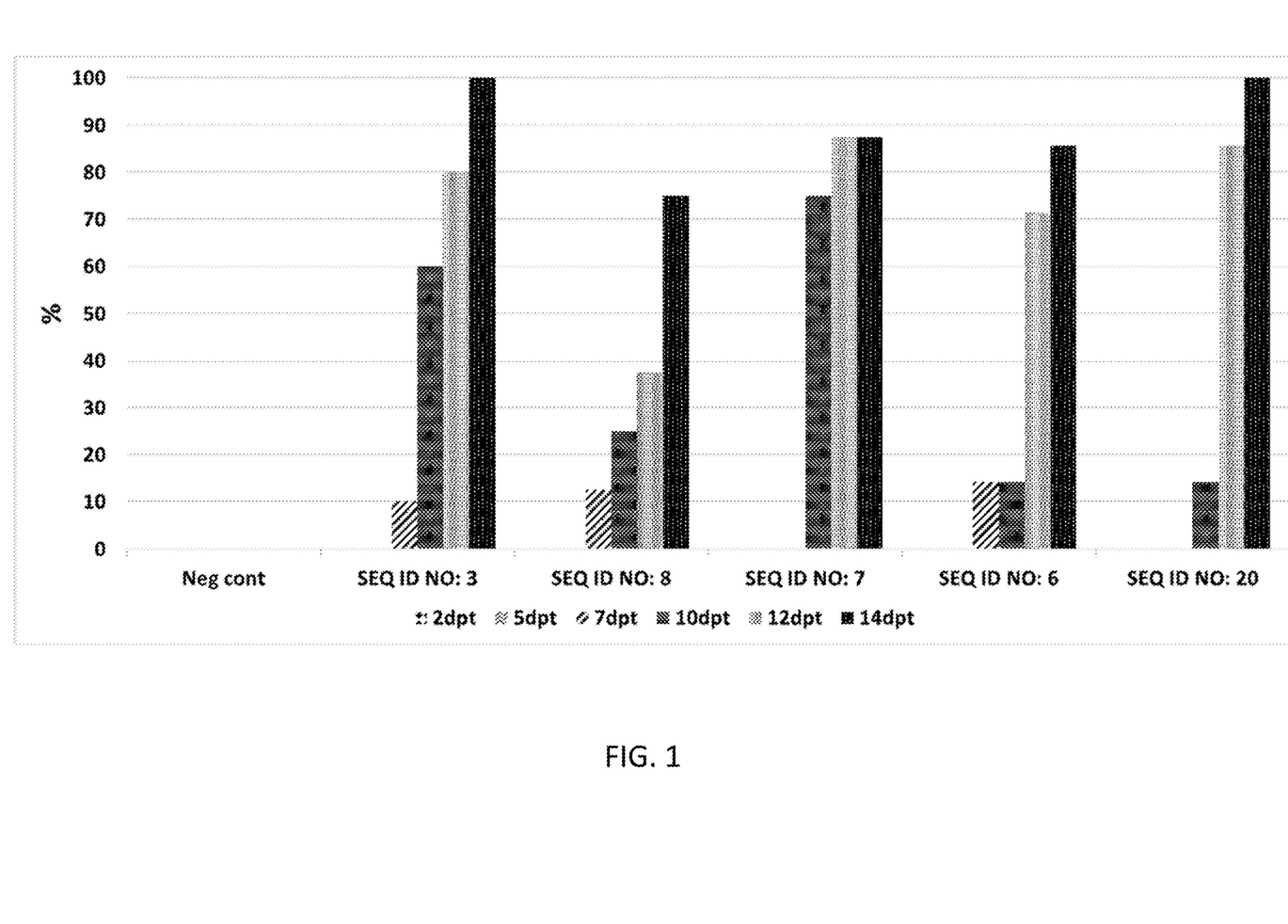
FIG. 1 is a representative graph depicting the percentage of dead red palm weevil larvae obtained as a result of feeding the larvae with 1 microgram/ml dsRNA targeting the indicated RNA sequences of the red palm weevil.

The results obtained for are shown in FIG. 1. The negative control is a 300 bp dsRNA of green fluorescent protein (GFP). As seen from FIG. 1, all 5 dsRNAs tested caused a significant increase in the percentage of dead larvae. Noteworthy, the dsRNA targeting the RNA set forth in SEQ ID NO: 3 and SEQ ID. NO. 20 showed a marked increase in the number of dead larvae 10 days after the treatment.

Similar experiments using the dsRNAs set forth in in table 2 below were also carried out. The dsRNAs were tested twice or more. The average and highest obtained percentage of larvae death for each target RNA are likewise set forth in table 2.

TABLE 2

| Percentage of Larvae death | | | |
|---|---|---|---|
| Seq ID NO of target RNA | Seq ID NO of dsRNA | Avg | Top score |
| 14 | 324 | 42.9 | 42.9 |
| 2 | 316 | 60.0 | 60.0 |
| 4 | 318 | 65.0 | 80.0 |
| 24 | 327 | 42.9 | 42.9 |
| 1 | 315 | 29.5 | 60.0 |
| 11 | 328 | 66.7 | 66.7 |
| 17 | 322 | 35.7 | 35.7 |
| 9 | 329 | 33.3 | 33.3 |
| 23 | 330 | 41.7 | 41.7 |
| 7 | 323 | 86.3 | 100.0 |
| 10 | 331 | 50.0 | 50.0 |
| 8 | 332 | 57.6 | 71.4 |
| 3 | 317 | 89.0 | 100.0 |
| 6 | 320 | 75.7 | 80.0 |
| 20 | 333 | 71.5 | 92.9 |
| 21 | 325 | 42.9 | 42.9 |
| 12 | 321 | 28.6 | 28.6 |
| 5 | 319 | 53.3 | 80.0 |
| 18 | 334 | 31.3 | 62.5 |
| 16 | 326 | 35.7 | 35.7 |

Figure 2:
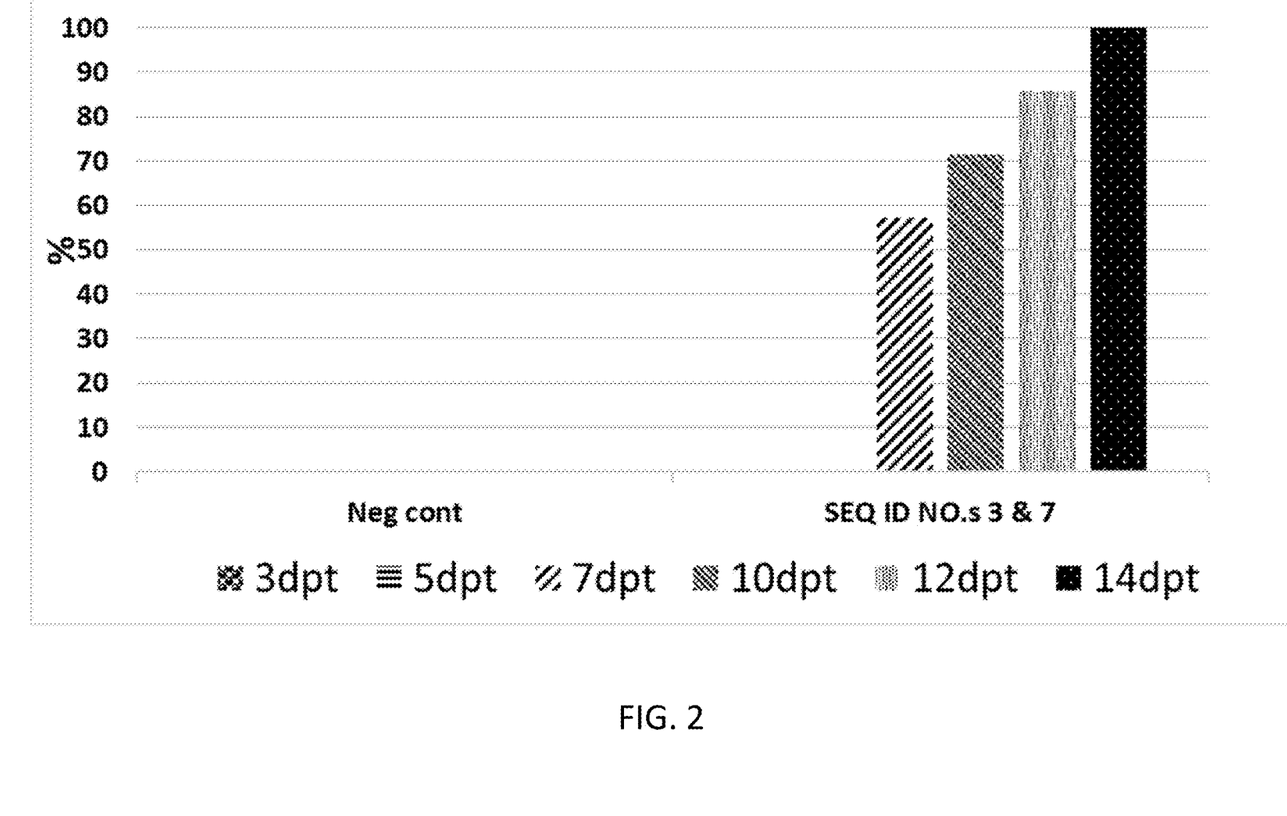
FIG. 2 is a representative graph depicting the percentage of dead red palm weevil larvae obtained as a result of feeding the larvae with a combination of 1 microgram/ml dsRNA targeting proteasomal RNA sequences of the red palm weevil.

To further test the efficacy of targeting SEQ ID NO. 3 and 7, both directed to proteasomal RNA, the above described experiment was repeated using a combination of the dsRNA set forth in SEQ ID NO. 3 and 7 (1 microgram each of ds RNA 317 and 323). As seen from FIG. 2, about 50% of the larvae were found dead already after 7, days of treatment, about 70% after 10 days of treatment and all larvae were dead after 14 days of treatment.

Figure 4:
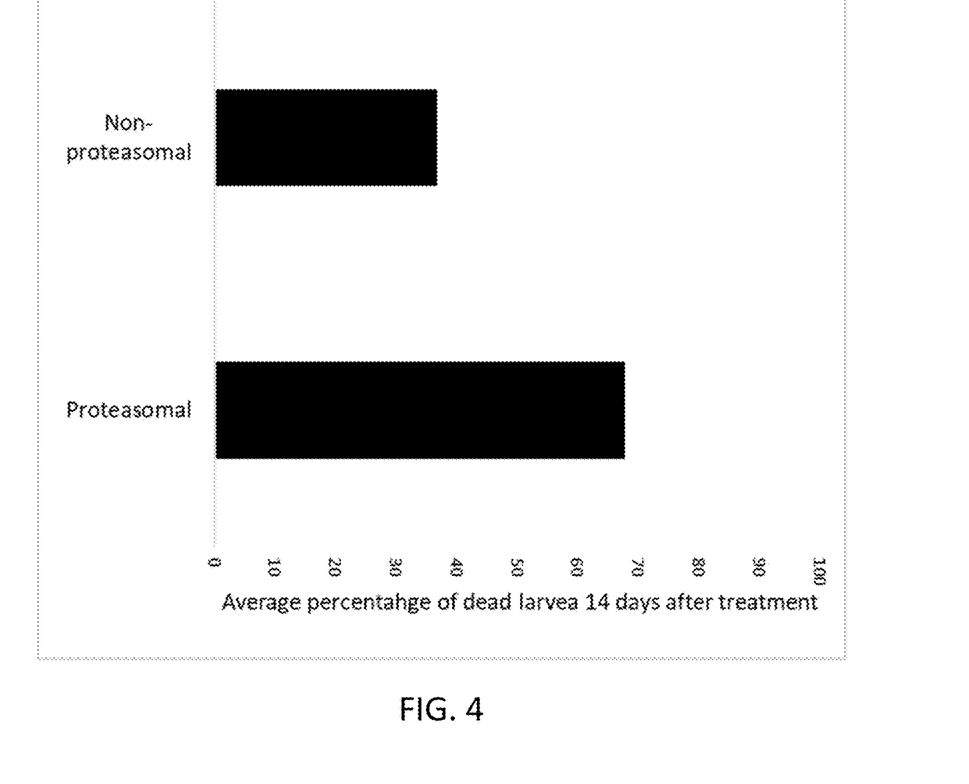
FIG. 4 depicts the average percentage of dead larvae counted 14 days after feeding of the larvae with 1 microgram/ml dsRNA targeting mRNA encoding proteasomal or proteasomal-associated proteins as compared to average percentage of cell death obtained targeting non-proteasomal proteins.

Unexpectedly, as seen from FIG. 4, the average percentage of dead larvae counted 14 days after feeding with dsRNA targeting mRNA encoding proteasomal or proteasomal-associated proteins (SEQ ID NO: 3, 7, 8, 10, 20 and 21) was almost two-fold of the average percentage of cell death obtained targeting non-proteasomal proteins (67.7% vs. 36.8%), and no other group of proteins caused a similar degree of larvae death.

Accordingly, the genome of *Rhynchophorus ferrugineus* was further analyzed for sequences having similarity to proteasomal proteins or proteasome-associated proteins. These target sequences include, for example, SEQ ID NO: 19, 26, 30, 47, 55, 57, 63 and 335-376. dsRNA directed against these sequences are analyzed for their ability to cause death of *Rhynchophorus ferrugineus* larvae, as essentially outlined above.

Figure 3:
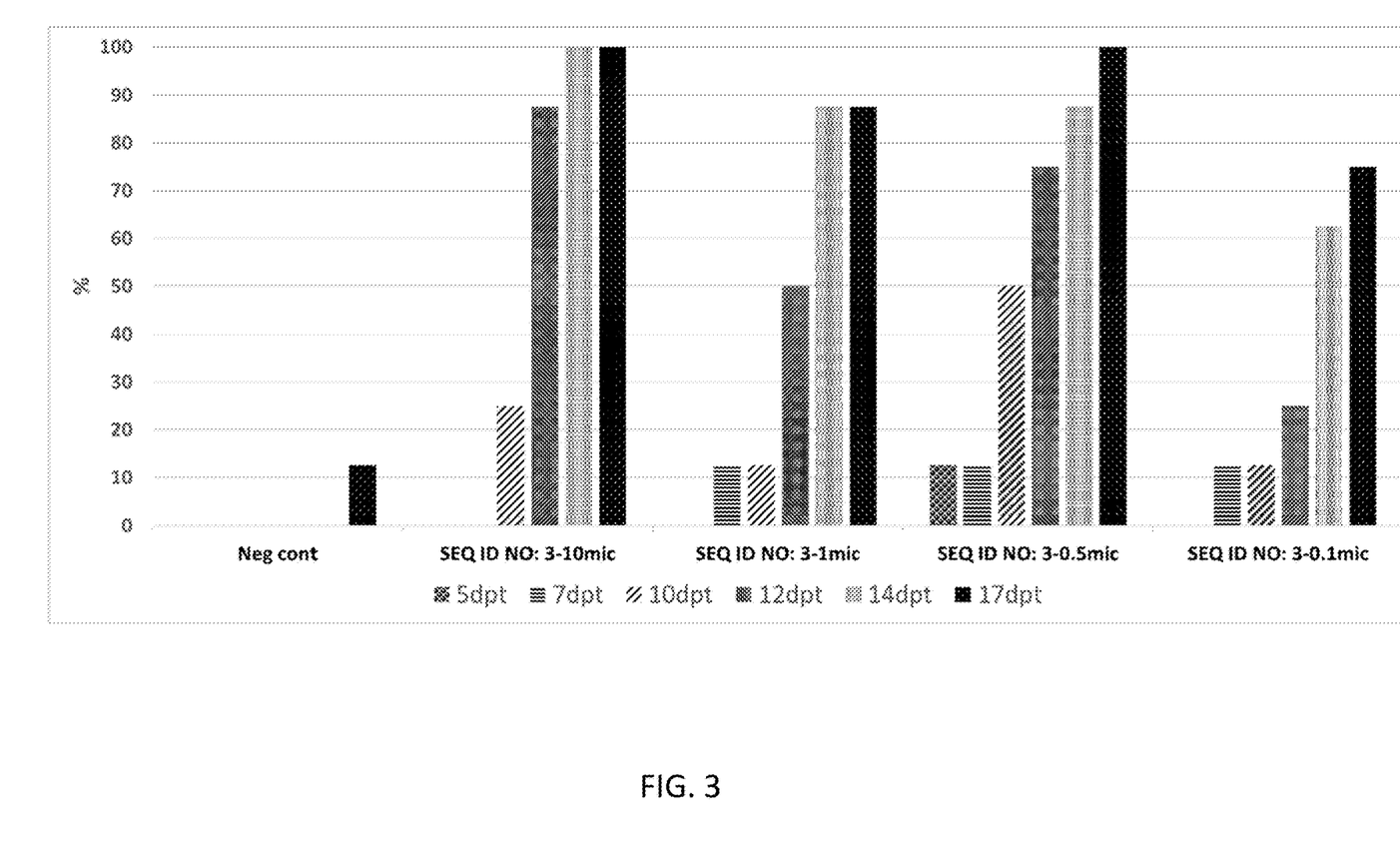
FIG. 3 is a representative graph depicting the percentage of dead red palm weevil larvae obtained as a result of feeding the larvae with different concentrations of dsRNA targeting a proteasomal alfa subunit RNA sequences of the red palm weevil (mic=microgram).

To determine optimal concentration, the percentage of larvae death obtained using different concentrations of the dsRNA set forth in SEQ ID NO. 317 was also tested. As seen from FIG. 3 all larvae were found dead 14 days after feeding using as little as 0.5 micrograms of the dsRNA.

Example 3—Injection of dsRNA into Palm Trees

Trees

Palm trees (*Phoenix dactylifera, Majhool cultivar*) were grown to approximately 1.5-2 meters height. The injection was conducted through a hole at the tree base made by a drill; three trees were tested.

Injection 10 ml of dsRNA solution (dsRNA dissolved in sterilized water) of the target RNA set forth in SEQ ID NO: 3 (SEQ ID NO: 317) in a final concentration of 10 μg per 1 ml was injected into the tree base. 4- or 8-days following injection, a leaf sample, located ~0.4-0.6 meter above the injection point was taken.

RNA Detection

Sterilized ddH2O was transferred forcibly (~250 μl) to one end of the petiole (leaf base) and was collected from the other side in a 1.5 tube. 100 of the collected solution used as template for RT PCR (Maxima) with one primer specific to the dsRNA set forth in SEQ ID NO: 317, followed by a PCR reaction using 2 unique primers.

Results

Figure 5:
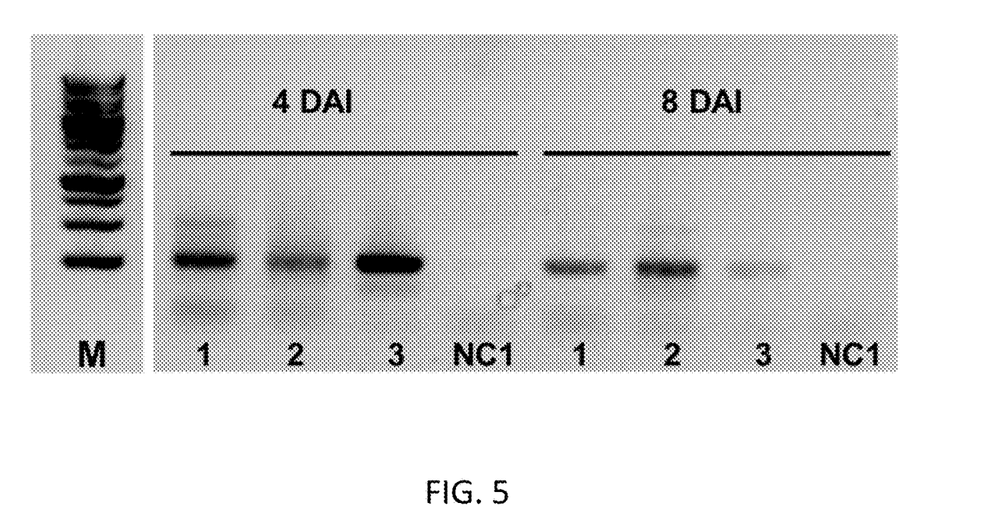
FIG. 5 shows presence of dsRNA in leaf samples obtained from trees injected with the dsRNA into their stem (DAI=days after injection).

As seen from FIG. 5, dsRNA corresponding to SEQ ID NO: 3 was found in the base of the leaves of all trees tested (indicated by 1, 2, and 3 respectively, NC1 is a negative control), thus indicating that dsRNA injected into the base of trees spreads through its stem and leaves.

Example 4—Feeding of Red Palm Weevil Larvae with Stem or Bark Obtained from Tree Injected with dsRNA Palm trees (*Phoenix dactylifera, Majhool cultivar*) are injected with dsRNA targeting one or more essential red palm weevil mRNAs, or a composition comprising same, as essentially described above.

The bark is collected as described above.

1-2.5 cm larvae are grown in a plastic cup-like container and fed with the bark (optionally crushed or grinded).

The containers are then placed in a dark humid location at a temperature of 25-30° C. The viability and change in mobility of the larvae is evaluated 4 times, for 14 days following the treatment.

Example 5—Preventing Infestation of Palm Trees with Red Palm Weevil by Injection of dsRNA Palm trees (*Phoenix dactylifera, Majhool cultivar*) are injected with dsRNA targeting one or more essential red palm weevil mRNAs, or a composition comprising same, as essentially described above.

The trees are then infested with larvae and/or adult red palm weevils.

The trees are monitored for infestation by evaluating dead or live larvae.

Example 6—Preventing Infestation of Palm Trees with Red Palm Weevil by Providing of dsRNA to Soil dsRNA targeting one or more essential red palm weevil mRNAs, or a composition comprising same, is sprayed or otherwise provided to the soil of palm tree plantation (*Phoenix dactylifera, Majhool cultivar*).

The trees are then infested with larvae and/or adult red palm weevils.

The trees are monitored for infestation by evaluating dead or live larvae.

Example 7—Treating Red Palm Weevil Infestation by Injection of dsRNA to Palm Trees Palm trees are infested with larvae and/or adult red palm weevils.

Following substantiation of the infestation (between 0-2 months) the palm trees (*Phoenix dactylifera, Majhool cultivar*) are injected with a dsRNA targeting one or more essential red palm weevil mRNAs, or a composition comprising same, as essentially described above.

The trees are monitored for infestation severity by evaluating dead and live larvae 3 months post treatment.

Example 8—Treating Red Palm Weevil Infestation by Providing dsRNA to Palm Tree Soil Palm trees are infested with larvae and/or adult red palm weevils.

Following substantiation of the infestation (between 0-2 months), a composition comprising dsRNA targeting one or more essential red palm weevil mRNAs, or a composition comprising same, is provided to the soil of the palm trees (*Phoenix dactylifera, Majhool cultivar*).

The trees are monitored for infestation severity by evaluating dead and live larvae 3 months post treatment.

Example 9—Treating Red Palm Weevil Infestation by Providing dsRNA to Palm Tree Shoot or Crown Palm trees are infested with larvae and/or adult red palm weevils.

Following substantiation of the infestation (between 0-2 months), a composition comprising dsRNA targeting one or more essential red palm weevil mRNAs, or a composition comprising same, is provided to the upper part of the shoot of the palm trees or the tree crown (*Phoenix dactylifera, Majhool cultivar*).

The trees are monitored for infestation severity by evaluating dead and live larvae 3 months post treatment.

While certain embodiments of the invention have been illustrated and described, it will be clear that the invention is not limited to the embodiments described herein. Numerous modifications, changes, variations, substitutions and equivalents will be apparent to those skilled in the art without departing from the spirit and scope of the present invention as described by the claims, which follow.

SEQUENCE LISTING (376 sequences)

SEQ ID NO: 1 - DNA, 1750 bp, Rhynchophorus ferrugineus
agaatttatcgctaactataatgtatataaataagtgaaaagaattagagtaggtaatacaataagatatattcgagtgacaataagtgtttcactatgtttcctgttattagttattggggtgttttattttgtgctggcatcacttattgtcaggaattgagccctattgtgacactatcggatggaaaagtccaaggaacagttcgtaagactgcccaagatggtaaaatttattatgcatatcgaggaatcccatttgctaaaaaaccaattggtgacttaagatttgctgctccagtaccaaatgatccatggagtggtgtattaaatgcgactgctgatcaagagagttgtacccaagcattatctctggataatttgtcagacattgttggatcagaagattgtctttatatcaatatctatactacaaatttaactggaaacttgcctgttatggtatggatatatggaggtggatttgtgtctggatcatctgattataacacatacgcaccagattatattttggataaagacgtgctctatgtgtcttttaactatagattaggaatatttggatttttgagcactgaagatttagcagcgccaggtaattggggactgaaagatcaaattttggctttaaaatgggtgaagaagaacatagctcacttcggcggagatactagtaaaataacaatatttggtgaaagcgccggtgcagcgtctgtttcgtatttggtcaatagtaatttaacaaaaggattatatcgagctgcaattatggaaagtggtaatgggctatgtttgtggtcgttgagtaggaatgctaagacccttgatagaacgtcttcgtcttgtggactataaacaattgaagtcagcagaaaataatgttaccgttaaaatcttatctgatggcgatatcttggctggtttaccatttgctgttgttcaagaaccagatcattcaggggcagttcttagtgggcggacttatgaaatattggctagcggaaaattcaacagagtaccttccattattggatacaattcaaatgagctcgcggcgaggattacgggatcaaattatttgctcgttatcggatttttgaatttgaaagttttgccgaaaaatttagctccatacgatctaactaatgtaacctccaaaaggaacgaagctgggaataaaatcaagaataaatacttaggatttttattgattacagatctagataaagcttttagatttgctacgatcgaccaattcaacagaccagtaaggaaaaccgttcataacgaaggaaaactgggaaattcaaatagaaccgtttcaggtgtccaacatgctgaagatatgaactatattttctacaaaaacgtatccgtatccgaaaaggattcattaacagtgaaaagagtcataactatgtggacgaattttgctaaaactgggaacccaacttcgtcaaatggaactggtgttcttcgaaacattacttggatacccaatacaccaagtactaacgttagtgaaagtgtgcattatttaaacataaatgatactgtaaccatgcaaaaaaatcctgaacaagatgactggctattctataaagatatttataacacttatggtgatccttcatattacaccacttattaacatttatttcatatttgtgccataatgttgaaataaaatattcacaactgttaaaaaaaaaaaaaaggaagagcgtcg

SEQ ID NO: 2 - DNA, 1082 bp, Rhynchophorus ferrugineus
ttccgatcactattctgccgttcaggacttacataggaagggacatgagattgccgtattttcactcactcacaaagaagatccaaattactggacccaaggatcatatgacgattggttagccgaaatggctggagctagattaattgtggagcgtttcgctaacattaccgatggatccatcattggcgtccgtgctccttatttgcgagtaggaggaaacaaacaatttgaaatgatgactgatcaattctttgtatatgacgcatcaatcaccgcatctttgggacgcgtaccaatctggccttacaccttgtacttcagaatgccacataaatgtaacggtaacgcccataactgtccatctagatcccatccagtttgggaaatggttatgaacgaacttgatagacgagatgaccctacgctctaatatccaaaccggagaacagttcgcccgtctcttgagacataacttcaaccgtcacttcaacagcaaccgtgctccacttggtctccacttccatgcctcatggctcaagagcaaaaaggaattcaaagaagaacttattaaattcatcgaagagatgttgggacgtaacgacgtatacttcgttactaatttgcaagttatccaatggatgcaaaatccaactgagctgaatggtcttagagacttccaagaatggaaagaaaaatgtgatatcaaaggtcaaccctactgctctcttccaaactcatgtgccttgaccaccagagaacttcccggggagaccctgcgtctctttacttgtatggaatgccctaataactacccatggctcttagaccccacgggcgatggtttctctgctagaagataaatttatttattaaactatcatgtttaggaagtgttttctaattaatttaaaagacttgtatatagttattatattttcctacttttcagaatctttagaaatagacttgccacatggtttattctttcaatactatcttatttgattataaacaataacaatgttaatttttacaaaatacttgttataaaataaagttttaaaactaaaaaaaaaaaa

SEQ ID NO: 3 - DNA, 1007 bp, Rhynchophorus ferrugineus
cctcaggtttataaataattcacgtgtgttattgttatatgctgatatcatcattaacattttttaaaaagttcttttgttctatagcacgagtgaaagtattataattgaaaagaagaaaaataagagaatttgatatttgctaattgtctaaaacttgcttgtcatatcttgttaattttgacagaacttttaaaacttgtttgtaatatcttcaagtgtacgatttaaatatgtctcttgctgttaaaccacattatcctgattattctaatgcgccaatacagcgcagttttaacccctatgcagataatggagggagcgtggtggcgatcgccggtgatgactttgtaattattggcgctgatactcgtcttagtgctgggttttcaatttacactcgggaacaaaataaactatttcagctatcccctacaacagtcttgggttgttcaggatgttggtgtgatacactaactttaacacgtattttgaactcaagaatgcaaatgtatcaacaagagcacaataaaattatgtcaactgaagcttgtgcacaaatgttatcaactatgttgtattataaacgattctttccatattacatatctaatgtattagttggcttagataataatggcaaggggtgtgtttacagctatgacccgataggacactgtgaaaaagccacatacagagctggaggatcagctggtgctttgttacaaccacttttggacaaccagattggtcagaagaatatgttaaatgttaaacaagaaagtgtaagtcaagagaaagctttatcgattattaaggatgttttcatctctgcagctgaaagagatatttatactggagacagtattcaaattaaaataatcactaaggagggtataaaagaagagaaatttgaattaagaaaggattaaaattgaaatatttctgtaaattttaataccaaattttactaaacgaaataaaatatattaaactaaaaaaaaaaa

SEQ ID NO: 4 - DNA, 1738 bp, Rhynchophorus ferrugineus
gaacaccttctagaggcagaggtacatctcactatagtaatggaagtggatcaggatctaataacgaagccacagctactgtaaatagaggcactcctgctactcgttctcggccaacactaaaaccatccacctccatcgtttccaaagctgccgaatatgtagatatctacagattcccaccaatacgccctgaaccaatttacccacaacctcaaccagacaaaacagcagccaaatgccgcaaggatgtttgtttgttgcctgactgctattgtggaggaaaagatattcccggagacttaccagtcgagcaagtaccccaaatagtcctacttactttcgatgattcagtaaatgatttaaacaaaggtctgtaccaagatctattcgaacgaggtagaacaaatcctaatggatgccctattgccgccacattctatgtatcccatgaatggactgattatagccaagttcaaaatctgtattctgatggtcacgagttagcttcccatactgtatcgcacagttttggagaacaattctcgcaaaagaaatggactcgtgaagtagctggacaaagagaaattctagccgcctatggtggtgtaaaaatggaagatgttagaggaatgagagctccctttttatccgtcggtggaaacaaaatgttcaaaatgttgtacgattcgaactttacctatgactcatctatgcctatatacgagaataaacctccaagttggccctatactttggactacaaattgttccacgattgtatgataccaccttgtccaacaagatcatatccaggcgtatgggaagtacctatggtgatgtggcaagatttaaatggtggaagatgttctatgggtgacgcttgcagtaatcctcccgatgccgatggcgtctataagatgcttctcaaaaactttgaaaggcattacactaccaacagagctcctttcggcttattctaccatgctgcttggtttactcaaccccaccacaaagaaggctttatcaacttcatcgacaccgtcttagcaatgaaagatgtctggtttattaccaattggcaagctattcaatgggttcgagatccaacacctagctcgaggctgaatagcttccaaccattccaatgtaactattcggatcgcccaaagagatgcaataatccaaaagtttgtaatctatggcataaatctggtgttagatatatgagaacatgtcagccgtgccctgatatctatccatggactggaaacaccggaattcgtagcagtagaatcgacaacgacattgaagactaaacgacagacaaaatctaaaatggaatttgtaaaattaaattattctaggccatttgacattatttttttaatgttagagaacttcttgtatttataattttttatcagaattattagttatatagagaacaaaagaaagatatgtccgatgatattgtggtgtcgatttgatacaaactcatacctcaataacatccacttttttaatatatttgtagtattttttgtatatattattttcttccaaagtatctaaatgtctaaaactattttcaataaaagtgttcatataattccttgacaaaagcttaatattgtcaatttgtaaaattattatctataatttattgtaaaccaattttgtacagaacaataaaacaaaaataattaaaaatccagtgagtagcgtaaaaaaaaaa

SEQ ID NO: 5 - DNA, 2740 bp, Rhynchophorus ferrugineus
actttatttatattattaattatataaacatttctttcatatatagggaattgtagatttctcaggttgctagcttcggtttcttccgcgatatcacatacaaaaaagttgtttatgtttgtggggcaccattaaaatccaaaaatatcttattcatctgttaaatctaagtcatcatattctttaaaaaaagccctgataagtgcagaccaatggcggaagcggacaaattaaacattgattcaattatagcccgattgttggaagttcgcggtgcaagacctggaaaaaacgttcaattaaccgaaaatgaaattagaggtttatgtttgaaatcgagggaaattttcctaagtcagcccattttactagaattagaagctcctttaaaaatttgtggtgacattcatggacagtattatgatttactacgtctctttgaatatggaggatttcctccagaatccaactatttgttcttaggagactatgttgatcgtggtaaacaatcactcgaaacaatctgtcttctgttggcctataaaattaaatacccagaaaattttttcttacttcgtggtaaccatgaatgtgcttccatcaacagaatctatggtttctatgatgaatgtaaaagaagatataacataaaattatggaagacctttactgactgttttaattgtcttccagttgcagcaattgtagatgaaaagattttctgttgtcatggaggtttaagtccagatcttcagtcaatggaacaaatcagaagaataatgagacctactgatgtacctgatcagggattattgtgtgatttgttatggtctgatccggataaagatcaaatgggttggggagaaaatgacagaggtgttagttttacttttggagctgaggttgttggaaaattccttcacaaacatgactttgacctgatatgtagagcgcaccaagtagtggaagatggatatgaattttttgcaaaaagacaattggtaacattgtttagtgcgcctaattattgtggtgaatttgacaatgctggagctatgatgtcagttgatgagactttaatgtgctcgttccagatcttgaaaccggccgataaaaggaaattccaatacaacatgaactcgggacgaccggtgacgccacctcgtggcgcaaccaataaaaataaaaagaagtgaattaatgattaataataatttattacgatacgtgttagaacctagacgttacgtttcactttgacatttcccatttatttttcttcttcattggctttaatgccctgcttgatcttcttacttgggatatattcagggacgtgcaaaatttgttatctcttcatacataatctcaatttaggttgtattcaacagggtattgaaatctgtgcataatccataaaatatcatgattgtgaacaaccagttttcagaagccgttcattttcattcatacaccatttaatttcataatcattttttaaagccccttaaaatgtatcttttataggttagggtttaaaatcatcccttcataatgttaatgtaaatttaatctaattccacttaagaggtatatttacttgttttgttataattttactgaaaatattaatttttctttatgaattgggagacagaaaattatttcattgttgctaaacatgtttaattgaattgtatctcaaacttgtagacatatcaaatggtttgttagtttctgtattgtcatccttttagaatttggtttagcaattatggtgctatgtaatacttatttaaattatgattgtggcattacagagatatatattatgtactgattacaggcatttaagttgtatatttaatttttttttcatcagcgtgccaaaatattcctctaatagtaagtaaaattaaatatcaaaacaggctaaatatattctcttggcataaagatttctaataatgttaagtttcagttgaatttagtcacagcttttgctctagtattaaaaaatgttataattgaatattaaacacctgaataattttttagtcttattttattaaaaggttttttatattgtagttagcttatagtattagaactctataaatttaaaatgtaaatgaaacaatgattatttattatgataggatgtaagttcaaaatcctaacaataaggtgttacttaaaaaatagaacagaaaaaccttgcccaaaataagtctaaaaaaaggtataacattgttggataaaattaacttaagtaagttaaagtgagtaataaggaaatcattattaaaaagggctgtataaaaacaaattttaacatgttaagtttcatcaaaaaggagttaaaggagatacctgaaaaactcaacttcagagacttcattcatttcttttttttgtttaattattttctgacacttgtataaaatatatttttatatgtattattttgttttgtttttatatttgttggctaggtggaactgagcttagttgttctccatatagatagattattgcacgattgggctgagtgcctaacctttccgcagctacaacttatcggtgtggcgctgtctgtttcgcgaatttaagttttgttcgctataaaatatgtttctcgtcagctagggtttttgtatacccgttggtattttatttttggatctagttaattttatgccttaataaattaaaaatgttttaataataaaaaaaaaaa

SEQ ID NO: 6 - DNA, 1369 bp, Rhynchophorus ferrugineus
gcctttattgttgtgacataaaaagttgctgatcattttaagtttttggttatttgttgtattagtggaaattaaacaaaatgcctattgaaaacctggaagatcaaggattagaaaaaaatcctgatttggagttggctcattataaatttttgctcactttaccggaatatcgaaatgataaaacagttcatggaaaaattacggaagcaattaaaaaagatgatatggctccttggtacgaattgatatgtcgggaaataggttggaaattggatgagaaactcctaaaaagtttaaagagtaaaaatgaagaacaaataaaaaagcttaatgaagctattgaagatgctgaaaaaaatttaggggagatggaagtaagagaagcctatctacgtaaagctgaatattacagtcgtgttggagataaagaaaatgcattatcaacatttcgtcagacatatgacaagactgtttcgctagggcatcgtttggatataatttttcatttaattcgaattggattattttttatggatcatgatgttataacaagaaacatcgagaaagctaaaattcttattgaagaaggaggtgattgggatagaagaaaccgtttaaaagtttaccagggtgcttattgcatggcagtaagagacttcaaaacagcagctaacttgtttctggatactgttagtacttttacttcatatgaacttatggattataaagcatttgttagatatacagtttatacttccataataagtttaccaagaaatcaactaagagataaagttgtaaaaggttctgaaattttggaagttttacactcagaaccatttgtgaaagattatttgtcttctttatacgactgtcagtatgcagatttctttgtgaatctagcaaaagtagaagaaatattgagaaaggattactttctgaatcctcattacaggtattatgttagagaaatgaagatactagcttacactcaacttttggaatcatacagaagtctgacattacagtacatggcagaagcatttggtgttactattgatttcattgatgaggaattatctacttttatagcaagtggcagattacattgtaagatcgatcgtgttggaggaattgttgagacaaaccgaccagatttgaaaaatgcccaatttaattctgttgtgaaacaaggcgatttattattacagcgcgttcaaaaactttctcgtgttattaacatttaaatgttcaaaacaaatgtcactgttcatagtataaggaaagtaatgttttttcttcactttttcttttgaacttagctgaactaactaaacaaataaagctgtatttatacaaaaaaaaa

SEQ ID NO: 7 - DNA, 5117 bp, Rhynchophorus ferrugineus
agtgctaacccttagataaccaaacatactttacgtttaaaaatgtctgtcattgtatttgacagatctttaaaactacaatatcattctttaaagttttgttgctttgattaactttaaaaaattccaaaccaaaatcatgtctagagggagtagtgctggttttgatcgccatataacaattttttcacccgagggtcgtttgtatcaagttgaatatgcttttaaggctattaaccaagccggccttacttctgtggcaatcaaaggaatcgatacggccgtttgtgtgactcaaaggaaaattccagataaattagtagatgctaataccatcactcatttgtttcagttaactgacaatataggatgtgttatgactggaatgatagcagacagcaagtctcaggttcaaagagctcgttatgaagctgcacaatttaaatacaagaatggttatgaaatgcccattgatgctctatgtagaagagttgctgatatttcccaagtttacacacaaaatgcagaaatgcgtcccttaggttgttcaatggttctaattggatatgataatgaaatggggccatgcgtatataaggctgatcctgcaggttattattgtggttatagagcagtggcagttggagccaaacaaacagagggtaacagttatttggaaaaaaaattgaagaagaagcaagatttacaacatgatgatgtgattcagttggctataagttgtttatctagcgtgttatctgttgattttaagccaactgaaattgaagtaggtgtagtttcaagagataatccgaaatttacaatcctcagtgaacaagagattgataaacatcttacagtaattgctgagaaggattgatcaccttcaaaggctttgaaatatattttctaaggttatttttttggttatatgctgtaactaagtaataaacaaggtttaaatataaaaaatatttttaattttttaaaacaattaagaaatttaatatgtctattttttgtctaatttagactgacacttgactagtgctattaagacttgtttctttaaggttatgttacaccggtttaatataattaaaaacaagtgcttcataattgtgttttgttttattatagtctaaaatctttataatgactgtggatatgcctgtatccttattaaaaaatccagaattaaaatttggagcaattacgtttttcgctaaacagcacaaaggggatacttgcggaagcaatggcctcccacttacacccaattctataataatagtgggcaatgcccaacttttgaaaacaatcaaaagccccttcttgtgtgattttcttgatataattagaggaaaacatgagagaacaattgtcgtatcacaatattgtggaacgcctcttgcaaaaattattgacaaacatgttcttacacacctacaaattaaaaagattgcttatcaggctctaaaaggtcttagtgtgttgcacaaattagacatagttcatcgaaatttaagcaatgaaaatatattaagacaagaaaatggtgatatcaagcttttcaattatggcctctatcatatgactaacagaggtgcattggtgtcttttcctgtcttagaagtattatatactgctccagaagtatatttatctggttttgattccggtcacgtggataaaaaagtagatatttggtctctaggtatttgtctagttgaattagttttaaataaacggttatggaattcactcaacttaggtcaaaggattaggaaaattttgagtttgttacaggtgaatacttctatttttgagaaaattgcgcgagaacataactgttatgaagtatacttgaatttgccagcagatttaaaggaactaattgaattgtgtttaaatatttatccaagcaaaaggctgtcatgtgaagaattattagataagttatactttaatgagtttagagatattcaggagcaaaaaaaaatgtgggaaccctttgaagttttttctattcaggaactgtattattggtggcagttagcagggggtgatgtatttcaagaattaaaaaaacaaggcttaattagatctagtcctcctattctatcactacccagtttggtattaatagaaggcacacttctgggtcaagatcgaaatccagccaccctttatgaccccaggattgttgagatgcctttagagaccttatatcaacgttttatacacattcctataactgccttttatccacttatacattctaaatcagatattatatcatcatcagacccaccaccatatgacgctactggtttgccactagttatcaaagaaaaagatccagaataccaattccacagggttattctttttagaagattacttcatggttatccttttacaaaagacttaataagacaggaggctgaaaaagatattccgcctctattacgaggagatgtgtggtctgcgctattgaatgttccacagggatatgaaagagattacatgaggctagataaatattctcataccactactgatcgacagatagaagtggatattccaagatgtcatcaatataatgagttactctcttcaacgcaaggtcataaaaaattgaagagaatattaaaggcttgggtatacaaaaattctcaatatgtctattggcaaggtttggattcgctcacagctccatttttatacctcaattttaatgatgaagccaaagcatttgcttgcctatccaactttataccgcgatatttgcataaattttttttgaaagataacactgtcgtcatcgaagaatacttggctaagttttcacaactaatttcgtttcacgatccgcagttagcaaaccatttacatgacattaattttgatcccaagttattcgccataccttggattttaactttattttctcatgtttttccattatataagattcttcatttgtgggataaacttcttctctgcgatgcatctttccctttgcatatcggcctgtcaattttaactcaattgcgggatagactgcttacctcaggttttaacgaatgtattttgctgttttctgatctacctgaagtagatatcgaaaaatgtgttattgcttcgatgcagacataccagagtactccaagaagcattacaagcagagaacatgaaaatgaacaattctataaaaaaaatgacctggatataaggggtgtaaccttagaagaattaaaaaaagaatcgtgcccaagaataagcgctgcggacattataaacactgtaagaaaaaatcccgataaaattctattaattgatatacggaatactacgctgtttcatcgaagctgtgtaaaaggaagcgtcaatattccattttcgagcgtatcatttaatgaaactgttcttgacaacttgggcacacacagttcactaattaaatctaaaggtgataaagttgttgccattatcggtgactgtgaaacagatttggagaggtttccgaattttctgttacaatgtaatgtgagcagggtttgcgttttgcacggagactttaatagatttacttcagttattccaaccatattaacttctggcacaaccaattaacactgaatcaatacaacttcattataataaaccagttttatttaacattaagttcatatagaaaatgaatggtccctaatccaataacctttccatttcaaatacataaactatatagatatataaaaaaacattatcttcaaattgaaattatttcagcagtttctttattgtattttctagtttaatagagtcggcagcaaattttcggatgccgtctgaaagtttatcagtagccatttggtcttcatttagaagccatcgaaatttagcttcggttaattctaatttttctactgaactcttagaggctgattctacactaagcttctgaggcagaagatcagtactggattccagttcacctaggagcttggggcttatggtaagtaaatcacatccagccaatgccttaatttcaccggtgtttctgaatgatgcgcccataacaactgtcttgtatccaaacttcttatagtaattgtaaatattggtaacagaaatcactccaggatcttcatcacctgcataactcttcttatctgtatttgcgacataccaatctaaaattcggccaacaaacggtgaaatgagggttactccagcttcagcgcatgctaccgcttgggcaaaattgaacagcaaagtcaagttgcaatgaatattatgttcagattccaatattttagctgcctgtattccttcccatgttgaagccaactttattaaaattctttccttttctataccttgatctgcatataattgaatgatcttttttgcctttgccacactagcctgtgtatcaaaagataatctagcatcaacttcagtggacactcgcccaggaacaatctttaaaatttcaactccaaaaagaacgcacagcatatccatagcattctctaatttttcagacaaattaccaccaactttgttggcatagtggattgctttctcaattaaaggttggtattgaggcaagttagcagcttgcagaataagcgaagggttagttgtggcatctgttggtttgtaagctttcatagcttcaaagtctccggtatccgccaccacagtggtaaagactttcagttgttccagagagctggtcatcttgcttcgtttacactgaggacttgcacactcggacattatgttttatagttaaatagctactttttatttgcaagataaattcaggcaagcgctttagttagaaacgtgcgtgacgttctgctgattgttcgcactaaagaacgttcaaaatgggtcaccaaggttatcgttatcgccttaagcgactattcgaggaccaatatgacttgttaaaaaacattagaggttgaacaaagtttatgtacagacggtttttttgaaagttaccttaatgtttggctgttaataataaaccgctatattcaatttttagtctatttatttggtgatgtaattataggtacatatagctctttttg

SEQ ID NO: 8 - DNA, 1147 bp, Rhynchophorus ferrugineus
acaaatgatacagcataacaagagtcgctatatcattgcttttgtagccggtgttagagtggtcgtttttcaaataccaattttctatcaacatgtttagaaaccagtatgatagtgatgtaactgtgtggagtcctcagggacgcttgcatcaggtagaatatgccatggaggctgtaaatttaggttcagctacggttggtttaaaaagtaaaaattacgccgtcctcatagctcttaaaagagcatcatctgaactgtcagcgtatcaaaagaaaatcatctgtatagatgatcatattggtgttactatttctggtttaacagctgatgctagaatattaagtcgctatatgagaagagaatgcttgaatcataaatattctcatgatacgtttttatccttatatagacttatttcaactttaggaaataaaatgcaagtttgtactcaaagatatgatcgtcgcccatatggtgtggggttattagtggctggttatgatgataagggtactcatatttaccaaacatgtccatctgcaaattattatgattgcaaagcaatgtccattggatctagatcacaaagtgcaaggacatatttagaaaagcatttagatgaattttcaagctctggattagaggagttgatcaaacatgggcttagggctttaagagacactttacccccagaggtagatttgtcaaccaaaaatgtatcaattgggtatgttggcaaagaacaacagtttaaaattttggatgaagaagaaactgcaccttacttaagacttattgaaggtgaggaacgcagaggagctccagcagataggcctttagcacctcttagagatgatcagggggaagaacccagagatcctgtaccagcagtagcaaccgaggcagcagagcatgctatggataccgattaacctgctatacaggatgctatgcaattaaaaagtggataattaagatatccatttttaattttcctttgaaaagctacattgagattgtgccgtggctactctattttgctttatagggtagccacggcacaaaaactaatattaatatgaattacatgtttttctaaagctttttcttaaatataattattcattgcatattaaaaaaaaaa

SEQ ID NO: 9 - DNA, 909 bp, Rhynchophorus ferrugineus
agtcgatacatttatgtttgagggtcatgatactacttcttttgctatatcaatgggcttgtatttattggctaataatactaaagttcaaaccaccgccagaaatgagctgaatgaaatttttggaaatgacaaaaataaagagacaactctgcaagacatcaacgaaatgaaatatctggatttggtaatcaaagagattcttcggctttatccacctgtacctcatattattagaacagtaaatgaggacattaaatttaaagatcatataatccccaaaggtactgatatagcactattcatatacggtatcaatcgagaccccgattatcacgacaatcccgaagcttgcatacccgagcgccatctagagaagaacaataaataccactttgcttatataccattcagtgccggcccaagaaactgtatcggtcaaaaattcgctttgctagagatgaagagtctgctatcgaaaataatccgaaacttcgaaatattacagacgaatcccgttaggataagattgagaccgatttaatttaattgtttgttttttttttgtatataaaacaatcaacagagtgtttataagtctaccaaagatatatattgtagttataaattaagaaaaagcacaaaagaaacttgtattttctcacttaaaataaccataaataaagtaacaaaaaattaaaaaaaaaaaatatctttttttccaaaggtagtgaattgaggcgtgtttgtccgcaaatatttttaatactgaaaaacctgtaacctcaacatcatgaagataagaaccacacactataacacaaaaactgtaagaactatgtatatatgtggtaatgtggtactttacttattggcaaaagtatatacaaaacagatcggaagagcgtc

SEQ ID NO: 10 - DNA, 1009 bp, Rhynchophorus ferrugineus
agaagatattgattaatgaaagtaagtaataggctatcttcagaagtgactagtgaaaattgaaaattagtgataaatataagaatgtcggttttatgcccagatattccagctcctggattttcatttgaaaattgtaggagaaatgttatgttagaaaacaaggggttagctctgcctaaagctacgaaaacaggcactacaattgtgggaataatatacaaagatggagttattttgggtgcagatactagagcaactgaagatactactgtagctgacaaaaactgtgagaagatacactacctagctccaaatatgtattgttgtggtgctggcacagctgctgacactgaaatgacaacacagatgatatcttctcaactagagttacatcgcctatacacaaatcgtgttgtgagagttgctaccgcaaaccaaatgttaaagcaattcctattccgttatcaaggttatattggagcagcattggtattaggaggtgtagattctacaggtcctcatttatattgtatttatccacatggttctactgataaattaccttatacaactatgggttcgggatccctagcagctatggctgtatttgaatctcgttggaagccagatatggaagaagcagagggggttcaactggttagagatgctatagccgcaggtatctttaatgatttaggttctggttcaaatgtggatgtatgtataatacgcaaaggagctgtagattatagaagaacatatgatgaagcaaataagaaaggtcaaaaacagaattcttataaatacccgaaaggtactactgctgttttaacaactaaggttgttgacattgaggaagtagtagtaaaaagatttgaatcagaagaaatggatactgcttaaatatatttgttttcattatttttttattcattataaatttatgggaacataacatttaactcaataataaaataaagccagtgtttcagtaaaaaaaaaaaaa

SEQ ID NO: 11 - DNA, 1839 bp, Rhynchophorus ferrugineus
ggatcattgagaaatcatacaaatcatgcacaatgatgggaaaaccgtggtttttggttttgtgatgatatccttgtgcatctgcgtaagttccatttcactgaaaacaccgatagttaaaacagtctatggtccagttcaaggacagcgagaactatccagatatggaaggtactaccaatcttttaccggaatcccgtttgctaaaccacctgttggaccactcaggtttgccgcccctgaagagccagattcttggacacttccattgcaagcaaccaatgttacaccagtatgcattcagcgggactatttggtcacttacaatccaccaacagaaggaactgaagattgtttatatttgaatgtatatacaccggaggttgaatatcgacataacaagttcgagaacaaactgttacctgttttggttttcatccactggggaggttactttgctggaaacagtggtaaagagtacctcggcccagactatctaatggataaagacattatagtcgttacatttaattatcggttaggggtatttggttttctgacaacattagatgacgaggctcctggtaattatgggttcaaagatcaagtattagctctgaaatgggttcaaaggaacatcgaatactttggcggagacaaaaataaagtcaccatcgctggacagagtgccggggctgccagtgtacatttccatttattgagttccgaatcggaaggtcttttccaccaagcgatttctcagagtggcaatgtattgggcccctgggcattctttaatgaaacctaccaaaaacagataacctcttatcaagcattgttcactaattgcggaaacgagacaaccgagacgaaacaaatcattgaatgcctgcgtggtttacccgctgaagaaattctcaagacgcaggattatttcaaaagattcttttcggatccattagttgtctatacatcaactgtagaaaagaaatcggttagaaatcctaatccatttttaatacaacctcctggagaatacctgaaaaagggtatgtttcggaaagtgccttggataacaggagtagtcaaagatgaaggcatattgaaagtatcaaatttgcttcgtaacgataacatcagaaatgccctcaataacaaatttgtagaagaaatatcaaacacattacttgcgttaactgttagtactaccgattccacaacactctacagtaacatatcgaacttttattttggaggacaaaataaaatcgatattaacaatcccaacagcatacaaggtttaattgatgtctattcagataggtcatttatatatccattgtatcaatcactgcttctccatctttaccataagcacaacccgatttatttatacagtttcgaatacaaaggtgaatatacatatggagatgtattttcttttaccacaaacgacatcagtttttcttggggcacttcacattgtgatgacctgctctacctattttatactccaaaatattttaacaaacttgaggctgatagagatatatgcatgagtaaatacatagttgaaatgtggacaaattttgttatttatgggaatccaaatttactagatgatgagacccaaaagacaagttggaaacctctggacactgccatcaataaagacaacattcaagggctgattcacctgttgaatataacgggaaatatcaaggacggaattgatataaagggctctaaatcattttacaaagaccgaataaacttttggaaaagtgtcgacattttagaaaatcattaaattataaatgactgtttcacaaaaaaaaa

SEQ ID NO: 12 - DNA, 2102 bp, Rhynchophorus ferrugineus
taagtatgggtgatatcagtgacttagatagacaaattgaacaattaaaacgctgtgaaataattagagaatcggaagtaaaggccttgtgtgctaaagcaagagaaatattagttgaagaaagtaatgtacaacgagtggattcacctgttaccgtttgtggcgatattcatggtcagttttatgatttaaaagaactttttaaagtgggaggagatgtcccagaaacaaattatctatttatgggagattttgtggacagaggtttttatagtgtggaaacttttttattattgttagctttaaaagttaggtatccagatcgtattacactaataagaggaaatcacgaatctcgtcaaatcacacaagtgtatgggttttatgatgaatgtttaagaaaatatggttctataactgtatggcgatattgtacagaaatatttgattacttatccttgtctgcaattatcgatggaaagatattttgtgtacatggtggattatctccctcaattcaaactttagaccaaattagagttatagacagaaaacaagaggtcccacatgatggaccaatgtgtgatttactttggagtgatcctgaagatactcaaggctggggagtttcacctagaggcgctggttacttgtttggatcagatgtagtggctcaattcaatgcagcgaatgatattgacatgatttgtagagctcaccaactcgtaatggaaggttacaaatggcattttaatgaaacggttttgacggtttggtctgcaccgaattattgctatagatgcggtaatgtagctgcgatattagaactaaatgaacacttgcaaagggacttcacaatattcgaagcggcgccccaggaagcgagaggaataccatcaaagaaaccgcaagctgactatttcctgtaactgtattaattagttttagattttaattttcctatatcattattattatttggattagagttaattcataaagtagcttttcggtgttgccgaagagctttcttatatttctggtttaaaatgatggtattattttgatgaaagacaatgttgaacaaatatctgttgtataagggacgaccaaccacaaaccatgatccagagtctaacgcgagaccctcggtacattatttattatggctttaggggtcctaaatatacagcattattaccctgctttgtataaaagctacgtaagtgtaatctagatttttgtttatgtacaatgaagaggattcagtatattctgtatttagtgtagccctaccttccattatttacatgagacaccactactgatcgttattctatatcattttataatttattctgatgttcaagtgatatccgatgcaggaaaagaaaaacaatgttaactatatgatttttttatttagtctcagtcgtcggcgcgaccgagaaacattgttaaatccggaataggtatttgtaagcggaactgccaaataaaaattttttacatgtacgtcttgtttcgttttcctagtgtgccacgattaaaatttgcccttggacttgtataatctgctggatatgacgtttttcatttttgattgcaagtccctggaatttaaattttccctccactctgcctccaacttaacccaaagtccaccaataggcatacagttctttccggtacttctattagttcttgacatagtttcacctatagtttttctacttagaatagcagacatttcttttattacgttttcttcatacgctctttgaatatcttgattacttctggctgataagttatgctgccacaatctaccttcgtttttcttgcgaggttttctagatatagtctcctgtggacgtagatgacgaaagagtctcctcttctgtgaactcttcggtggtgctttcatcggaaacaaaagattccgcgtcatcttcgctgcctctgttagcaaacgcgctcaacagtcccattttcgggcgaggcgggataatttgaaatccatcccaccaaaaattctccttacagacgaatttctctgaactagtgttaccggaatctgtttaaataaaaaataaataaat

SEQ ID NO: 13 - DNA, 3345 bp, Rhynchophorus ferrugineus
ataaaaatgtcagaaaatacaaaatcgaccgttctgtcttctaaattaggaggtgggccccatggcgttggggatcccaatgataaaagtcttaggagagtcgaattagatgtaatgattcccaaaaaaatgagagatatagcccgtactgaaaaatgttttcaggaagtagctgattttactcagtgttgtaaaaacaacaatcttctaatggtagtaaaatgcagggcagaaaatagcaaactgaaagattgtcttaccaagtggtataatgatgaggcttttaaggaacactgtaaaaatttatatttagaagaaagaacgcaatttagaagtactggtattccacttaaaaaaagactagaacagaatacaagaattggttcaaatatgtagttttatttataaaataatatagtttttcttatgtatgttcaacaataaaaggaatgttatatttcatcccgttcttgagaaggaacccatctcctaatcagtacttcttctatttctatattgctgaaatcattgtactgaacttgtgatggccaatgaattttacatataagcaactcctttccagcagtttcacatagtctattaagtgctgacaaactaacattatctagagagaggtcttccatttgattctctaaattagaattgactatttggattattactacataactagcatgatagaaaggaggaccttgcttataaagcaagaaatctccaccaaatttaataccaggctttacaacccatttttttgctttatagtaataatatactatataattcctgatgaatgtaggttgtgtgttactgaataattcccacatattctcaacagttaaaatatcatttttataagtaacctcgagacaaccaaggacattagtaagaaagaaggcctcttccaaacccaaccaaactgtttcttttatatttgagtaatccaattcaaacttaggctttaaatttatgaaataattattatcttcttcatcactattaggcacaacaatcactttttctgcgggctgtttcacattggtatgattaaaattatcctttctatacttgaattgcctttcccttaaaatcttacacgtatcacttttagtaaattgtggataacttcttgaaaaattagcttttccaaaataccccattgaaactaagtttttcatatcatccgcgtcgctaacaataactgcaaatccgttaaagttagccgaaaatttcttaatggaaccgtctttcttaaatattataggaagaggtaattttggacgaagtttgcaatgtcgctttgctttgggttctattaactccatattgaggaaaattcaaatcgtccgccggaataatatgtttatctttgtttcacacacgtgataactgtcaatgtcatgccaatgaaggactacgtcaataatcacaagactgtattttgtggaagtgtccgaagaggtgtaacttacatattctttggaagaactaaaaattcactggaccatggcttcgaatttatcaggggctgaccctaaaatcaaagaaatattggaagatgataaaactgatatgttagctgctactagtgtcttgcaacaaaaagctactgacattcgcaatcagaaagtaaactggcagtcatactaccaatctcgaatggtttctcaagaggactataattttattgtcgcttttgatgtcaatgatagccagaagagagagggcttgctgagaagagatagaaaccaatgcgcgcaaactttcttaaatttattaggacatgtttcaaaagaccaaactttacaatatattctggttttaattgatgacatgctacaggaagatcgtagccgtgttgaaatctttcatgagtatgcaaacaagaaaaaggagcctgtttggggtcctttcttgaatttactcaaccgccaagatggttttattactaatatgacatcaagaataattgcgaaaattgcttgttggtctcagacacctatggaccggtctgatctacacttttacttgacctggttaaaagaccaactgaagtcccaaaacaacgaatatatccaatcggttgcgcgttgcctccagatgatgctgcgtattgacgagtaccgtttcgctttcgtttcagtagatggtatttctacccttctttcagtactagctggacgtgtaaatttccaggtgcaatatcagttgatattctgcttgtgggtgctcaccttcaatcctctcttggccgaaaaaatgaacaaattcaacgtgattcccattctcgctgatattgtgagcgactcggtgaaggaaaaggtcaccagaattatcttggcggtgttcaggaatttgattgaaaagccagaggatcatcaagtagccaaggaacactgcatcgctatggtacagagcaaggtgttgaaacaattgcaaatcttggaacagcgtaaattcgacgatgaagatatcgtagccgacgttgatttcctttctgaaaaattacattcatctgtacaggatcttagttcatttgacgagtacgctactgaggttaaatcaggacgtctggaatggtcaccggtacataaaagcaagttttggcgtgaaaacgctcaaaggctcaacgaaaagaattacgaattgttacgcatcctcatccatcttctggaaaccagtaaggatcccttggtactcagcgtagccagttttgatattggagaatatgttaggcattatccccgtggaaaaaatataatcgaacaactgggcgggaaacaactcgttatgcaactgttggctcatgaggatcctaatgtgcgctacgaagctttgttggctgttcaaaaactgatggttcacaactgggaatatctaggccgtcaattagaacaagaagcgggtgctgaaaaaagcgtaggaaagggggctgctccagtagcaggcaaagcgtaatttcctagccgggttgcaaatgtattttattgtcatactaagcagtatttctgtttttatagatttttaagggcctgtgaatcatccgattcaaccgttacttggttgaaatagttgtacatacagtttctttcaaaaattctgcagcttaaaaaaaattgaacgatccgctgtggttctttttgtatgtataaaattaacattcccgtatatctgctaaaagctgtaattttaccatgtatatacatatgttcattatgaatgaacaagtcattattaactaaatttgaaaatatctatgtttttttgttgattattatcacattattgtagtgaaaaatatatataatagttgttgaaaaaaaaaaa

SEQ ID NO: 14 - DNA, 1291 bp, Rhynchophorus ferrugineus
ttcgtacgacaaaagccaatattcctccggcagcagttgaagtgacgtcgaccgatggtggtctgtatgtaggccgagtataaaagcagaaagcgaggttgcacaggtcctgtcattttgtgtccggccagaggtgttagtagtgcttcttagttcttgtagtgatggcgcgcatacaattcgcgcttctcctgctcggttctatatgtgcctataccgctgcccaaagtgaagagcccgttaaaaaagaagatagttttgaagctgagctttgtaaagacaaagatgccggtgaatggtttcgactggtagctggagaaggcgataactgccgtgatgtcatccagtgtacatcctctggtcttcaagctatccgttgcccagccggtttatacttcgacattgacaaacaaacttgcgactggaaagactcggttaagaactgcaaactgaaaaacaaggaacgtaaggtcaaacctctgctcaacaccgacgagcctttatgtaacgatggattcctcgcttgcggtgatggtacctgtatcgaaagaggcctcttctgtaatgaagtgaaagactgcaacgatggttccgatgaaaattcttgtgatattgacaatgaccccaatcgtgctccaccctgcgacccagccgtatgtagccttcccgattgtttctgctctgaagacggtactactatccccggagatctgcccgctaaagatgtaccacagatgatcactgttacttttgatgacgctattaataacaacaatattgaactgtacaaggaaattttcaatggaaaacgtaaaaatcccaatggatgtgacatcaaatcgacgttctttatctcgcataaatataccaattactccgccgtccaggaaatgcatcgtaaaggtcacgaaatagccgtccattcaatcactcacaacgatgatgaaaatttctggtctaatgcctccgttgaggactgggctagggaaatgggcggacaaaggctgataaccgaaaaattcgcaaacattacagataacagcgttgtcggcgttcgtgctccatatttgagagtgggaggtaacaaccagtttacaatgatggaagaccaagccttcttgtatgactcaacaatcaccgctcccttgaataacccacccttatggccttacactatgtacttccgtatgccacacaggtgtcatggtaaccttcagaaatgcccgaccaaatcacatgccgtctgggaaatggtgctgaacgaattagatagaagggaagatcctaccaa

SEQ ID NO: 15 - DNA, 272 bp, Rhynchophorus ferrugineus
tgtcaatgtacctcaaatgattacaattactttcaacggtgccgtaaatgttgataacatcgatctttatgaagaaatcttcaacggacaaagagctaaccctaacggatgccagataagaggaaccttcttcgtctcgcacaaatacaccaactattctgccgttcaagacttacataggaagggacatgagattgccgtcttttcactcactcacaaagaagatccaaattactggacccaaggatcatatgacgattggttagccgaaa

SEQ ID NO: 16 - DNA, 2053 bp, Rhynchophorus ferrugineus
caatgggaatggcgacgacactgacaagtatctgacagtcacgtgaaaactctgacgatcagctgtccttgcgggagtggttttgttggtgaatttttcggggtttcagctacaacagtttcactgaataaagaaagcacaaggacccgcacaaagaccagagtgaagaggatataaacatgacggagtattggctgatatctgccccaggtgacaagacgtgccaacaaacatgggaaactatgaacaatctcactgccaaacaaaactctttgtgtgttaattacaaattccaaattccagacctaaaggttggaaccttagatcagctggtgggactatcggatgatttgggtaagctggatgggtttgtagaacaggttacaagaaaagtggcatcctatctgggcgaagttctcgaagatcagagggacaaattgcaggagaacttgatggcgaacaacactgatctaccaagttatttgacgcgcttccaatgggacatcgccaagtaccccatcaagcagtcgttgcgtaatatcgccgatatcatcagcaagcaagtgggtcagattgatgccgacttaaaggccaaatctagtatttacaacaccctgaaaggcagtttgcaaagtttggagaaaaaacaaaccggtagcttgctgactcgcaacttggccgacctcgtcaagaaagaacacttcattctggattctgattatctacaaactttactcgtaattgtacccaaggctttgtccaatgactggaatgccagctatgaaaaaatcacggatatgattgtgcccagatcgacccagctgattactgaagataacgattatggattgtatactgttactctattcaagaaagtcattgatgagttcaaacatcatgctcgtgagagaaagttcatagttcgcgacttcacctatgatgaagagcaattggcagccggcaagaatgagctaacgaaattagccactgataagaagaaacaatttggtcctttagtgcgttggttaaaagtcaacttcagtgaatgtttctgcgcatggattcacgtcaaggctctgcgagtttttgtggagtccgtcctccgttatggcttgcccgttaatttccaagccatccttatccaccccaataagaagacgatgaaacgcctacgcgatgtccttaaccaactatacggtcatctcgacggcaccgtcggccaccaaggctccaacgtcgacaacgtggacattcccggactaggcttcggccaatccgaatactttccatacgtttactacaagatcaacgtagacatgatcgagtctaaactgtaaataacttccccgaaacgttattcccaccacgtcgtttttattttctttttctttgttaaatcacaagctgtaaactattttattccaatattttaatgttacgttaacagtcgtagattatttttaggtagagagcgtctacaccgttatgtcaccattttggattatcactttattcgaaaatgatatgaatattatatatcctgtttggagtttagcaaaatttagtgcaatatgaatggggaggaggccatgccttccccgtccaactcgcgataatatatcgtggacgctcgagatgttgtttttatccttctccccccaataatgtttaatgtataaaagaaacagtatttaattcattgtaaatatcatgtatatatttgcaaacagttatttttaaaaaagatgaaactgacctagttgaagagggagttttttcgatgtccttggaggcatttattctttgctacagttaggctatactaagctattacaatttgttacgggcgatctcggagggattctatttttgccctctgggcatttttgcgacataaccacaaacaaatctcgccgatctaaaaaattatatttaaattgttttaaatatgtacttgttagaaataaatattattttagaaaaaaaaaaatataatgcttcttgatgtccactttattacgtcacaaaccttccttcaattcgagaaatacac

SEQ ID NO: 17 - DNA, 603 bp, Rhynchophorus ferrugineus
aatgtgacacttttcggccaaagcgccgggtcttcttcagtacacgcccatattctatcacccatgtctaagggtctgttccacaaggctataatgcagagcggctgttgcttgaactcgtggttttggggttcgaagaataacgccagggaggtagttaaagccatgggaattcaagtccagaccgaagcggaagctgtgaagattcttcgagctgtcccagcgattgatattctgaacgcacaagataaaatacctgagtcgttgtttccaatggtacggagaccattctccgcggtggtagaagcacctaatccccatgcgttcttctctgagagtccagtggacataatcaagagtggtaattataatcacgtgccggtcatcattggttacacggacacggaaggatacctcaacgactacgacatgtttgtttccaagaagttgggagcggaatttccaagatatgacatcagaaaactgataccttacgagctgaatgtgaacaaagcagaggacgtccaggaaattgttgaccaatttcgggcgttatacgtggccacatcaaatatccggcatcacgatgaatacactgacgct

SEQ ID NO: 18 - DNA, 1626 bp, Rhynchophorus ferrugineus
gtcgacaatcgacaggcagttactgttttatggttggcaacaaattacattttttttaggtttgttctagtaaaaaaatggcagagcccgaattaaacgttgatagcttaattcagaggctattagaagtaagaggatgtcgaccaggaaagtctgttcatatgactgaagctgaagttagaggcctttgtcttaagtctagagaaatatttttacagcaacctatattattggaacttgaagcacccctaaagatatgtggcgatatccatggtcaatacactgatttactacgcctgttcgaatatggaggtttcccacccgaagccaattatcttttcctaggagattatgtagatcgtggtaaacaatctctcgagaccatttgtctcttactcgcgtacaagatcaaatacccagaaaatttcttcttactccgcggaaatcatgaatgtgcatccatcaacaggatatatgggttttatgatgaatgcaaacgacgattcaacatcaaactatggaaaactttcacagactgcttcaactgcttgccgatcgctgctattatcgatgagaagattttctgttgtcacggtgggcttagtccagatctacaaggaatggaacagatcagacgtataatgagaccaactgatgtaccagatacagggttactttgtgatcttctttggtcggatccagataaggatgtacagggatggggagaaaatgaccgtggggtgtccttcacttttggtgctgacatagtcagcaagttcttaaataggcatgacttagatctaatatgccgtgcccatcaggtggttgaagatggttatgaattctttgcgaagagacaactggtcaccttattttcggctccaaattattgcggagagttcgacaatgccggtggtatgatgagtgttgatgaaactctgatgtgctccttccagatattgaaaccatctgaaaagaaagcaaaataccagtatcaaggagtaaattccggccgtccttcgacaccgcagaggaatcctacagctaaaaagaaatagagtgaaaatagagcaataaacacttatctaactttattttcattttattcaatattataaacaaaaagcattttaactgtagtgtactttctcacctcttttttttcattgtggcagattataaagtcggtccttaaaacgatacagagtattatttatctatgtttattattttattatctatatatttttttagtttgtaaagaatcgactgattaatggtgtgtgacactaaaaacaactgttactcttatttgtaaataatcacatttcgctttaaagcatttaaaatatggaatttgcaacatatatcagccaaagagtctgcgatttggcgcaatttattgttattatttatctcgtgttttaaatacgacacattttatgttattgaggttgtggctaagcctttggcatacagtgtgtataaatttgtgtaagttaaaaggaaactgaggacaggttgtgcattcattttgtttctgttattgttcattctctcatttaataatacaattttcagtgcactgttttatggtactttttttttattctgttagacatagat

SEQ ID NO: 19 - DNA, 1050 bp, Rhynchophorus ferrugineus
ccttattctatctcattctaacctagctattcggtgttgtcatagtttttgtaaactcattctgattaaattgttttcttgtttaaagtcttatacttttaataacaaatatgagtttggctgagttatgtggcatggaagacacgggggctttcaaattcagtaataatcttaacgacgatataacaaatttctgcggcaatttttcttcccatatccaacttggagttccaccatttcaaaaccctgctacggatttagccaatttagcaaaggacgattttggtcgtgatatcaaaatcaaatttgatcatggtacgaccaccttaggttttatgtatcaaggaggagtgattctggctgtggactctcgtgcgactggtggtcaatttattggttcccaaaccatgaagaaaatagtagaaataaatgacttcttacttggtactctggctggtggtgcagctgactgtgtttattgggaccgtgttctcgccaaacagtgcagaatgtatgaactcagaaacagagaacgtatttccgtggcggctgcttcaaaactaatgtccaacatggtttataattataaaggaatgggattgagcatgggaatgatgcttgctggttatgataaaaggggtccacagctctattatattgactcagaaggtactcgcactcctggtaaagtgttcagtgttgggtcaggctcaatctatgcctttggtgtcctagactctggttataaatgggatttgactgatgaagaagcatatgaccttggacgcagatcaatttatcatgcaacacatcgtgatgcatattcaggtggtattgtgagggtataccatatgaagcccacaggatgggtgcacattgataataatgactgtctagatttgcattacaagtatcaagcggaaaaagaagatgttgaaaataaaatttaatttctctaattctgtatatttaattgtcttaattaacattatgtggctacaagaagcacctttttttcaataaaaatatatctgtaataaaaaaaaaaaa

SEQ ID NO: 20 - DNA, 753 bp, Rhynchophorus ferrugineus
gtgatttaacctaaaaaaataaattaccaagcgttttcgtgtataccattacttgctttacaaataattgaattttacaatggaatgcctattgggtataaaatttaacgattttattataattgcagctgatagaactgctgctcagagcataatggtcatgaaatcagatgagaataaactttataaattgtcaaataagttagttatggctgtgtctggagaatctggggatacaacacaattcgcagagtatatatctaagaatattcaactatataaaatgcgaaatacatatgaattgagtccaagagaagctgctgcctttactcgcagaaatctggcagacgcattacgttccagatctccctattttgttaatttacttcttgctggatttgatgataaagaaggaccccaattatattatatggattatttggcttctgtagcaaaagttgactatgctgctcatggttatggtggatatttttcgctttcaattttggatagaaactatgtgaaagtcatgactccagatcaagggtatgatttaatgaaaaaatgtgtgcaggaaattcagaagaggctaatagtcaatcttcccaacttcaaagttcagattattgataaaaatggcatcagggatatgccagatataacatcaaaatcatttgaataatacattcttacatgcatactaataaataagaatttataaataaatatttggtttgtataaaaaaaaaaaaa

SEQ ID NO: 21 - DNA, 1646 bp, Rhynchophorus ferrugineus
gttcgataaaataataattcctagtgccatgttataaataatctaagcggtttgtagtggtaaataaaaaacaccacaaaaataggtccttcgaaaaaaatgcctttacaatttatggctatggcgcagaatgccgtagaacctatgcaggtcgatgcaccacccgaggacaatgacaacaacgaagaaccattttacatggtggaaaaccccactttggacctagaggcctacgctaacagttacacaagtctggccaaattataccggctaatatatgtcgttgatcattgtccttcattgcgactggaagccctgaaaatagctatctcctatgttatgacaacttacaatgttaatttatatcaagtgctacatcagaggttaagcgaattaacatcaaatttgaatgtcccggacgttgcggcgccgtccgcttcccaagacgttcccctaatagataacatgtgggtggaaaccaggttaaagaaatccgccttaaaattggagaaactagacaatgatctcaagaactacaagagtaactccatcaaggaaagcatccgaagaggccatgatgatttaggcgaccattatttagactgtggtgatctctcaaacgctttgaagtgctactcgcgcgctagagactactgtaccagtggaaaacacgtcgtcaacatgtgtcttaacgtaatcaaagtgtctgtttatttgcaaaactggtcccatgtcttgagttatgtagctaaagccgaagcgactccagacttcattgaaacacaagccaaagatagtaatccccttttatttacgaaactgagatgtgcggctggccttgcagaactggccacgaggaaatacaagcaggccgcgaaacatttcctgcaggctagccttgaccattgcgacttcccggaacttttatcgccgggtaacgtagccacgtatgggggactgtgcgctttggctacattcgacaggccagaattacagaaacacgttgtgaacaatggaggtttcaagcccttcttggaactggaaccagcgctccgcgacgccatcttaaagttctacgagtcgcggtatgccgcctgcttaaaactcctggacgaaatgaaggattcccttttgttggacttgtacttggccccccatgtccccgccttgtactcccagatccgaagcagagccctggtccagtatttcagtccgtacttatcagccgacttacgtagaatggcgcaggctttcggccgtaccgtaccggccctcgaggacgagctcatgaaactcatcctggagggacagattcaggctcggatcgactcccataacaaggtactgttcgcgcgggacgccgaccaaaggggcgcgactttcgagaggggactcgcagtgggtcgcgaacagcgtaggagggcccggatgctcgttctgcgagcggccgtcttacggagccgcctccaggtccagagccctccccgagagcagggcgagggcgcccaacaacaaatgcaaccggttacgagcgccaggagctaagggaatgctccgtgagatatatttatttcgttcgtttttgtaaatacgtaaggaatcattattgggtaataaaacaatagataaacgttaaaaaaaaaaaa

SEQ ID NO: 22 - DNA, 1106 bp, Rhynchophorus ferrugineus
cgtatttctatattgcgaatatttaatatattacttggtacaaatgaagtgttcatggcctacgttagatcctttaaatgaggatatttctattaaacaatctgatgaagcaataaaagttatgataatagcagatacacatttgctaggtagtctaaaaggccactggtttgataaaatcaggagagaatggcagatgtatcgggcctttcaaacagctatgcagttacatagtcccgacatagtttttgtattaggtgatttacttgatgaaggatccttctgcagtgatgcagaatttcagtattatattggtcgattttacagtttattttatgtaccagatacaactcagatgcatatagttgttggtaatcatgatattggttttcactatagaattcatccccatttaacaaacagatttaataaagcctttaaatcatcacctgtgcagttaataagtataaaaggtgtaaattttgtcttgatcaacagtatggccttacaaggagatgggtgttttttgtgtagacctgccgaagaagaattaaacaaaattgaaagaagtttattgtgtgcccaaaatttaactgcaaaatgtaataatatttataaattagcaacttacagcaaacctataatgatgcagcattacccattgtatagaaaatcagatatagaatgctttgattttgatgcagcacctgttcgagaaaaggaagaaatatttagggagacatgggactgtctaagcatggaggcaacatatcagatactgaagcaagtaaaacccagattggctttttctggacatacacatcatggatgcactagaaacatgccttttggagatggaattgaaatcactatacccagctttagttggaggaataaaaataacccgaactatggtttgggggtttttacagccaataattatgcattcataaaatgtgagatgcctaaggaatcagatgtaattttctattatataataggagttatcggtacaattttctgggtctttttaaaacctgttatgtggaatctttatcattaaatatgtatagttttaatgatattaaaatcagttttgattaata

SEQ ID NO: 23 - DNA, 1683 bp, Rhynchophorus ferrugineus
gccatcgtatcgcgctgacttacggacggaaaaatcgtacaatgcttacgataatactatctattgttctcgtagttttgttgcacgtgtggtgttttttcagtgaatgcaagaaaccaacaaattatcctccaggacctccgtggttacctttcctcggcagtctatttcagttgaggtcgttaagtaaaaaagcgggcgggcagcacgtggctttgatgcaactgacgaaaaaatacgcctcggatgtgataggattgaaattagggtcggagtacgtaatagccgtatgttcgtacgcctccgtgcggaagatcttaacgtcggaggaatatgaaggacgtcccgacaatttctttttccgattaagatcgatgggtacccggaaaggtataacgggaacagatggtgaattatggaaagaacaacgagcttttctagtctctcacctcaaacagttgggctttggaaaggacaatgtagaacagatggttaaagatgaaatcagagatattataacaagaatggaacataacttaaacaatgtcaatattgcagaggttctagcaccatcagtattaaatattttatggtatttaacaagtggcaaaaacttaagaggtaatcagcgtgtgactaatttgctagaactcttgcacagaagatctaaagcatttgacatgtctggaggtatgctcaatttatatccatggctaaggtttcttgccccagataaaacggggttcagcttgttgcaaaagatcaattcaggtattagcgactttattagcgaagctattgaggaacataagaagtccttgattgatgaggataatagtgatgtaatttatgcatatttaaatcagatgaacaaaggaccgaatggaaaaaagtattttacagatgatcagctggtaatggtttgtttagacatattcttggctggatcaactactaccactaacacaatcaattttgcattgtttgctatgacccaatatcctgatatacaagaaaaagtttataagtgtattgaaaaccaatttgaacctcaatgtgaaatctcatatagtgataaacaacgagttccatacattgaagcagtattattagaatgccaaagattttttcctgtggtgccagtgattggaccaagaagagtcttgaaaacatgccaactggataactatcagatcccaaaggattccactatattaataaatatctatgctgttcatcacgatcaagaatattggcaagatcccgaagagtttagacctgaaagatttttggataaccaaaataaactgattggccacgaaagagttctaacttttggattaggtaaaagaagatgtttaggcgatgccctagcgaaaacgtgtgtttttttgttctttgtgacgattctgagaaagtttaaattggaagctataactaaacagagcgaattagatgacaacatagcagggatcaacatgagtccacaaaaatataaagtcaaacttacaccaagaacagttaatcagtaggattaatagcaagattttttacaattatgttataatcagtatgaataatgatattaatatttatttttaataacaattgtataatattttataaaagttttaacttattataagagcaatattattttcgtgatagtattgtgtaactcac

SEQ ID NO: 24 - DNA, 1770 bp, Rhynchophorus ferrugineus
atctatcgacggcagaaatcctgccgcgtaactctgtctgctagtcagccagtaaaaattagtttatgtagcgtaaagaagcggtaattcgataaaatgcggtttttgacggtttttacgttagtgactttcagtgtttttaacaaggttatcagtgatggaaaaaacgaggaatttcaatgtccttccgcaacgggtacaggaaattttgcagacccagtcacttgtcgccgattttaccagtgcgttgatggatatccgtacttaaacagatgcccttccggtctgttctttgatgacataagcaagttctgtacctttaaaaatgaagccagatgtggacccatcgctacaacaccagcaccaatcacagaatctcccactgatttagcagaaaaatgcaatcctgccgaatgtcaactaccatactgtttctgttcccgagatggcaccataattcctggaggtttagagcccgaaaataccccccaaatgattattctgacattcgacggggcagtcaacttaaacaattacgatcattaccggaaagtgctgaacggcaagaggaagaatccaaatgggtgtgctattaaaggcacttttttcatatcacacgagtacagtaactatcatatgatccaaagattagcaagtgaaggtcatgaaataggaaccgaaaccatttcacttcaatcaggtttacaagataaaggctatgaagaatgggttggtgaaatggtgggaatgagggaaattttgaaacatttcgcaaacgtttccaaaagcgaagtggtaggaatgagagctcctttcttaaaaccgggaagaaacacacaatacaaggtaatggaagaatttggttacatatatgacagctcgattggcgttcctgcattgccaatacctatttggccatacacactggactataaaattccacacgaatgcaaagcaggaacttgtccaacaaagtcattcccaggtatctgggaagttcctcttaacgctcattatgtagaaggattcgaaggtggacattgcccctatttggatcaatgtgttttacacaatcatgatcctgaagatgtatttgattggttgcaggaagatttcttgagatattatgatcagaatagggctccctatatgatgccattccacacaaattggttctcaattaaggagctagaaaagggacttgaaaaattcttagactgggtggctacactagatgacgtatggtttgtcacagctacacaagccctgacctggattactgatccgaaagacgtaaagcaattaaaaaattatgatgcctggggttgctccaagaacgaaaatcttccacctaaaccctgtaatttatccaacaagtgcgcactaggtttcaagaagaacaacatcaccgatacaagatatctggaaacttgttcagattgtcccaaccaatacccttggttaggtgatgctagtggctctggtataccaaataaagacaattacgtgccagataatgtatagacaatagtttctagatgtaggaagtaacgcaaaagctcttttgtactgattactattgattattgtttcattttattgttttaagtaatacaacactgtggatcttaatgaaagatttttttactgttgctcttattgttagtaaaattattgtattactgttatcgttttaaatcagtgttctgtcatatagtaaagcaattttttggccttatttagatatgtgctatatattctaataccaat

SEQ ID NO: 25 - DNA, 213 bp, Rhynchophorus ferrugineus
cattacattatattaacaacacacacaaagatttggacttagtttattttactggtgatataattgatcactccatttggaaagattcgcatcaagataattccaacgatataagatttgtatttgaccacctagcccaatcatttccaaatatacctatcttgccaactttgggtaatcatgaatcagtaccattaaatatgttccctcctc

SEQ ID NO: 26 - DNA, 1310 bp, Rhynchophorus ferrugineus
aatctctattcgctctatggtcgaaatccgacgaacgttttgacacggccaacgggcgatcaatcaatgtcaatcgcgattgcgttcttgcgcgcacatcgaaatggaaacggcagaaaaatccgagagtgaccaggcaatattttacgacgccctgtgccacggcttcgatcgaaccgaaacggccgacaccgatgacaagataaagattcccaatctggaaattgctcaagtgaaatttcacttaacgctgcccgagttcgcgggagacgatgaaaaaatgacgcgactgatggccagcataaaggccgacaatatggcaccgtactacgagctggtctgcgatgagctacggataacgactgacaaatccctgttgaagagtatgcaggaagccaacaggaaatctatcgaatatctcgactcggaaattgattacgcgctgaagaacctggggaccgctgacgtgaaggaaacgtatttaaacaaggcgaattatttatcgaaaatagggaacaaaacggaagcaatagccgccctggatctggcttacaagaacacgatcgctctgggttgtaagctggaaaatattttccactgtatacgattgggattgttctttcacgacttggagctgatgaagcaaaacctgtcgagatgtgaggaactgacacaagagggagcagactggcattataggaactgttttaaaatatataaaggcctgtactccttggcaatccgagacttcaacaccagcactcaggtattcaccagcgtcatctcaaccttcgtgtgtaccgagttaatttctttaaacaccttcattaaatacaccgtgttgtccgccatgctggttctgaaacgggccgacttaaaaacgcaactaattacgaacccagatgttctgcaggcgttcaatcaggaccacgcactcgaagaattcgtcttctctctgtaccgcggcgatttcagggaatttttcaagagtctggcgcggatggagaccgaaatgcgacgggacatgctgctccatgcccattacggctactacgtcaaggaaatgaagataaaggcctacgatcagttactgtcgacgtacatctctctgaacctgtcgtatatggccgaacagtttggcgtgaccgaggaatacttagaaaatgacatttacaacatcatctccagcagacggcttagttataagatcgataaaataagcgggaagatagtgaacgtgcagccgaatcgaagaagtcacatgctcgatgatattttcaagcatggcgacgtcctgcttaacaggaccc

SEQ ID NO: 27 - DNA, 2011 bp, Rhynchophorus ferrugineus
tggaatcaaaacaaaacccaaaaaacgtccgggcgaataatggcacttaaacaatcgattaattgacaggacgaacaacaatccagcatctcgtcgaggcgagccggcgaacgatagccaaaccgatggctcaccaagccgacagtcatcatacgcgcgtacacaattgaaaatcgcagtgtgccacgcgaaccgccgtcaaaacgacaatcgcgccagtgtggatctcggagtcggttttagcttcgaatatgtccgaaccggtggtggatatcgagcaggggacgctgaaggggtgcgaggccgttgactatcacgggggaccgttcctcaagttcttgggcataccgtatgcggaagctcctgtcggagagttaagatttaaggcaccagtcccgccaaaaccatggaccggtgtcagagatgccaccaaagaaggaccagaatgcccgtccggcgatatgtactttacttactacataggaaacgaggataattgtttaaatttaaatatttatacgaaaagcttgcctaaaccgaacgaaactaagaatgcacccgttatggtatgggtacatggtggtgcttttacgacgggatgcaacaaggccgacttctacgggcctggatacctcatgacacaagatatcgtattggtggccatcaactaccgactggggattttaggatttgcaagcttcaaagacaaatccttggacgtacctggcaacgctggtcttaaagacatgagattggcgttgaaatgggtgaagaaaaacatcgacaaattcggcggcgacccagacaacgtgaccattttcggcgagagtgccggagccgctgcggtgcactatctcaccctgtctccgaccacagaaggtctattccacaaggcgatcattcagagcggtagcgcattgaacaactggtcgtggggcaaaaacaattcgacagaaattgccaagtgcatgggttacaaggagacagacgagaagacaatcctgcagaggttaaggaaggagagcgccaagagtatcgtagctggccagaaaaaaatgaaagagaatttcttaccctcctgcattcgaccttggggacccgtggttgaaccaccctctgaacacgcctttctcacggagagtccagtccaaattatgcaccgacaaggcagccgcaagattcccatgataatcggctacaattccaaggagggcttcctcttcgagctggtgaggagacagtattccggggtgagcctaccggagaagttcgagctcgagctcccctacgagctggaactggatcacgaacacgaaaagaccaaagaactggcggagaaggtgaagaaacattatttcggcgaagatgtctgtaacgaggacaatatcgatcaagtttacttgttgaaaggcgacgttaactttatacacggtatccaaagaatgataaaactgcaagccaaacattcagatcagccggtatacgcttatcggatgtcgttaatgagcgacctgaactacttcagtacctttgccctgtcgaagaacttcacctggacaatattcgtcacttttatgtcgaaggtatcgccggtcatgaggaactacttcaaacatcacctgaaaaacatgccaaagaaacaaatccacggagtgggccatgccgacgacctgtttcatttgtttcacacgttctttacgccgactatcgagaaaggcagtcaggaagacttgtcctcatgataacgacgaaatcttgaattccattaaatggacgcagttcaatccagaggaaaaacattttctggacataggtcatgatttgaagatgacaggtgacgtagatcgagaaaggatgcaattgtgggatgaaatttatgagacacatttgaaaatataaaatcgaaccgttaatagagttcaactaggctgtagatttatttttgtttttatttttggaaaggttttttttaataaaagaaaatacttacactgttaaaaaaaaaaaaaaa

SEQ ID NO: 28 - DNA, 1072 bp, Rhynchophorus ferrugineus
tcttacggtatatttgtagaaaatattgtttatttttaatgctatagttaagtcacaatgcacaatctcctttttttcattaagcagagccggtatgaacataaggttgcgaaaagatagatgaatttgcatttatcgtggttaattccgtccaagtactacagacagaaacgcggaaaatgcatagccgcggtgatatagcgttacttacgatttcatttattgtttgtttttttaataatggttgctgtcaaattcctatagtgaagattgctgatggcttgatacaaggaaatattgctaaaaccataggagaaaggaagatttattattcttataaaggtataccctatgctcagccaccaataggcaacttaagatttagggcccctgttaaaaacaaaccatgggaaggaattttaaacgctactgcagacaaagatggatgtgtccaacaaatggattttctaccacttgctgttaaaggttctgaagattgtctgtatcttaacgtgtacaccaggaatatttcaggaaattatccagttatggtttggatatacggaggtggcttctcgattggaggatccgaatacgaatactatgctcccgattttctgttggagaaagatgtggtgttcgtttccctgaactacaggttgggtatcttcggattcctgagtactgaagatatggaatgtccaggtaattggggcttgaaggatcaggtgctcgctctgagatgggtcaaggaaaatatcaaggcgtttggcggtaaccctgaccaagtaacgatttttggtcaaagtgctggctcagtatctgtatcttacctggtacagagtaaacaaacaaaaggtttatttcaccgcgccataatgcagagcgggtccagtctctgcatctggagcctaacgaccacggccagacaaatagcgttcgcaatcgggtctaggctgggtattgtcaccgccaactcgaaagaattgttggccaagctgagagaggtcgaccataacaccttgaaactagcggagaatcaagtcgtatatttggcgattgctatagacaa

SEQ ID NO: 29 - DNA, 370 bp, Rhynchophorus ferrugineus
tgcaattattccagcattcgaccatttaaaaggaggatttactgtcgatcgatggtcagttcgcgcgccataactaaaaaaatgtccctggaggttttgctgttcttggttcttcagatcctggcggtgtatggtgaatctgaattaccggattttttacaagtatgtaagaggaacgaaccaaatttatcttcatgtattgtggattcaatcgagaaccttagaccatatcttattacaggagtacctgaatacaatatcccaagtatagaaccactgatcatggagaatttattggctgacgaaacaccgaacttaaaaattacggtaaccaacgccagtgcctggggatgtagtgattttatcataa

SEQ ID NO: 30 - DNA, 784 bp, Rhynchophorus ferrugineus
tgtcaagttaggatgacagttaaaaattaatggaagggaagaaacattgttttattttgtagtaagccgttcattaatagttgtgaatttacaaatacaataatagtttcaaaatgtctatcctagcttataatggaggcgctatggtggcaatgaagggcgagaattgtgtgtcaatagcagctgatagaagatttggcattcaagcacaaactgttgctacaaactttgaaaaaatttttgagatgggaccacatctttacgttggccttccaggccttgctactgatacgcaaacagtaatggaaaaacttcgctttagaaaaaacttgtatgaattaaaagagaatagatcaatatcaccaaaagtatttagtgctatgttatctcacatgttgtatgaaaaacgttttggaccattctttgttgaacctgtagtagcaggtttagaaccaaagacatatgagccattcatatgtaatatggatttaattgggtgtataaatcaaccaaaagattttgtggttggaggaacagcttcagctcaactttatggaatgtgtgaagccctgtgggaacctaatttagggccagatgatttatttgagactacttctcaagctctcattaatgcgtttgacagagatgctatctctggttggggtgcaactatttatataattgaaaaggataaggttacaattaagaatttaaaaaccaggatggattaaaattttcaaatttaagttcataataaacatttaatttttaaaaaaaaaaaaaa

SEQ ID NO: 31 - DNA, 903 bp, Rhynchophorus ferrugineus
tgaggaaggaaatcaacgaggttttagatcgacatgatggaaaaataacgtacgacgccatgatggaaatgaaatacctggacatggtcgtaaatgaatcgctaaggaagtatccgccagtggctatccttcctcgagtgtgtagcaagaactatgaagtacctgggactaaggtaacaatcgaaaaaggcacaaaagttcaagtacctgtctggggcatacatatggaccctgagtattatcccgaaccggagaagtttaatcccgaacacttcaccccagagaacaaagccaaccgaccagagatggcgttccttccttttggcgaaggtccccgaatgtgtatggactgatcagtttattgaagaatttcaaattcacggtgaacagcaagacccatacacccatccaaatagagaaagttagttttgtgttatctgttgaaggtgacgtttggttgaacgcctcaagagtataagttttaaggatatttttgattaataatacgttattttgtaatctattttgaaaaaaataatcctaagtaaatcagatttttaattttttatatttgttgttaattttcatagattgtttcatagtagatagtagataaaagttgtattaggtcaagtcataatatttagaaatatatatactcgttatcaactatatgtgatttgtattatatttatttaaacaaacactctatgtttgttttaaattaaattcgttaatggtgtatgtgttatgtaatgtatattttatttaatttttgttgtattaaatgtatttaaaatttatttatacctgacaatttttaatccttcctatctttattttatggaccaaactgtaataattttgtcaccagaaaaatatattgaataaaatatcgacaaa

SEQ ID NO: 32 - DNA, 1555 bp, Rhynchophorus ferrugineus
aaacaacgcatgtaaaaaacaaacgtacaaaatactgtagttctgtacaaacagtacctaattgccacaaaatcggacattatagaaaatattattgtttacgccgaatctagaggtcgattattagttgtgtacgaacatatataaagggaatagatgcgatgtaaaataatagttcgagaagtgaacttgtggtgcaactatatagtgaattgcagattggttaattaaaagattgaaagatggcgctctggttaatatttctttgctggtccaccttagtgactctcttattatatctatacatgactagacactactcctattggaaaaaaagaaaaacattccacattaaaccaactcccttttttggaaacatcatgaaatcgatgacacttcaaaaatcaatcggcgatgtcatcaaagaattatataacagcaccgacgaagactatatgggaatattcattattgataaacccgttctactgatacgatcgccaaaacttgttaaggatattttactcaaggatttcgccacattccccgatcggtgtgttgttagtcccgagacacccgtgtttacatctggtaaactcaaagccatgtctactctgatagcgaaggaggccgaacaactgaatgaatatatagggaaacattgcaacaaacctaacttagaagccaaagagatttgcgccaaatactcaaccaatgttattgctatatgtgcctttggtgtcagcgcaaagtgtttcgaaagtgaagatgccgaatttagaaatttcggtcgtaggatattcgagttttcagtggccaatatgattagacatataggatgtttcttcacacccaacattataaagctatttcaaatatcttttgtaaaggacgaaatcttaaataggctaggagatatattcactgaggtgctacacatttcccaagcaatacaattctttgtagccggttttgagacagtgtccggtgttttaagttttgctttatacgaattgtgtattaacccggacattcaggaaaagttgcgacaagaaattcaggaaatcacagaaaaacaaggattaacttacgactctatacaagagatgaaatatctcgacatgtgtgtttcagaaactttgagaaagtatccggtattaccatttctggaccgtgtctgcaactctaactataaactagaagggaccgatcatgtgatcgaaaagggacaatcggtctacatttccatgttcgggttgcattatgacccgaaatatttccccgaaccacacaaattcctaccggacagattccgggataaaaatagcatcaatcaggacggcttttattacattccgttcggcgagggacctcgaatctgtattggaaacagatttggattgatgacagtcaaaataggcttggcatcgattttaacgaaatacagattatgcaggagcagcaaaacaccagtacctattagattccaggtgaaaagtttaattgtgcagtcagatgttggaataccactaaaatttgaaccactgtaattttt

SEQ ID NO: 33 - DNA, 1483 bp, Rhynchophorus ferrugineus
aggcgaactgagtatttaacttgccgtttaggagcatcattagctcattgctttgtaaacagaattattttaaatttgttttgttttcgacgaattctccagacttatcattctatttaaactaattgtactaagcagtttatttcagtttgcatcgagatggtcgccctatcgcatcttatcttcttgataattacggttacgggtatttatggatatcctcagcaagatggaatcttagaacagattaacttaggaaccaaacaattgcaacactcggatgtaataccacaaagcttaacagaatccgtacaaaaaatcaaaaacatcacagatgcaaaacaaaaatctgaaatggtttgtagagcttgcgagatggtagccggcaatgtcatatcccttagaaaaagcctggccgatagggatacaatgattgattatttaaaaaaactttgtaatgtgtataccgactttggaccaatcgcctgtgagggttatgttaatcttgacgttgacaccgttttatttgtcatcgactatagagcaaattttacaccagcaagattttgctcaatacgcctgcaagaatatcaatgcatcgatccccaagccgagccgtgggtaataccacttccacccccatcgcagctggcatctgaatcagctacaagcaataaaaccacagattcaaagccacttaatattttacacctaaccgatattcattatgacgcactctacaaacacggtagcgatgcacaatgtaaggaacctctttgttgtgaagaaggcactcctagtaaacctgaaaatgcggctggatattggggtgactacaactgtgatacacctctagaggcgattgaagatttacttaaaagaattaatgacaaacataaaaacatcgatttgatatatttcactggcgacatagtcagtcataaatcatgggcaacatcgatacagtccaacagagaatccattagattaatattgcaatttttcaataagtcttttccaaatataactatatttccaatattaggcaatcatgaatctcatccatcagattacttctctccactaaatgctttgtttaccaacgtgacaactgaatggatattcgatttagctgccgatgaatggattaaatggttacccattgaaacccaatcaacgataataaatgggggatattacaccgtgttggtaaagcctggttttagagtggttgctttaaatagcaatgtatgcttttcaagtaacctgtggttactatatgatgataaagatccctttaatcaactcctttggctagtaaaagttctagcacaagctgaacaaaacaatgaaaaagttcacttgttatcacatattcctcctggagaacttacctgccacaaacaatggagtaaccagtttgcgaaaatagttaagagattctccaaaacaatagtggcacacttcaatggtcatacacaca

SEQ ID NO: 34 - DNA, 1359 bp, Rhynchophorus ferrugineus
taaactagttgtagtttaattcaaatgtaattaaaatataaattatataaagagtaattgttcctataggcgtagtaaagttgtcagtcatgctactcctaacgatattagttacgctccttgggctattccatttctctcatggaacattcagatattgtaaggattctggatcgaatttagaagcgtgtttaatcgaagcaatgaatgatgctttacatcagttaaaaacagataataaagaatacgatttaaaaaacttggatacatacagaattccatccatttcaattaaagcaggaactggagcagtacatttcgaacaaaactacaggaacatagaactatcaggactcaccgacgccgtgataaaagagtcatacttcgatagagatacaaaggtattttccttcactgcagtaattcctaaattgattcaaaaagctgattacgatattaacggaaaactactcacattaccggttactggttctggatcgtcttatctacaattagacaatatgaatttaaaaattgtactaactctcgaagagtataccagagatgggacgcagtactacaaaattaagtcaataatcttagatatgcccatatccaagttaagcggacacttcgataatcttttcaatggcaataaattactaggggacaattttaaccgtttactcaacgacgaatgggaagttatatataacgacataaaacgaccactcgaagaagcttatgaagatcaatttaaaatgtatattcaaaaatttttagatcaagttccagcgaaagaattgttttaataatgtagcatatagcattatttgtatcatagttatttgatagtgttttaataacaaaatataaacttttatcaaactattatacatgtaagataatgcaaaaaagcgtcaaaatattaatggactttttttaaatatggtgtttgtcatcttgttgtaattggtgtgaattttttggaaaacaccttaatcttactctatcgtcaccatatcttcagagacactatacattataaggccttgtataataaatacaaaaatattgaacataaaatatcatcaacgatagtaagtaatctaaaattagtgtgatggcgtcatgactacactgttgtatcttaaaaaaatcaaataattcgagcgccttcgccattttgaaaactactaatttttgcaactctgaaaatcagatatcatttcttacgaatttattctactatgcagtgtatcagctttatattcatatggttattctaaagtatgttttattcaaatggttatgttgatactattattaatctgtgatatatttgattgaatctaagct

SEQ ID NO: 35 - DNA, 1172 bp, Rhynchophorus ferrugineus
ctgtcagtttcaacaaacgttggattgcttcacctggtaagtatatgttgtggacataattgtttcccttgcgaatcgacctatcctatataaaaacgaacattgatgatcgtagctcgacaattgatgcttctcgcgccacaaactcgtcatgtttcacgtcagatacgcatttatttatttgttttttgtttcagttttatgtgacatacccgaatatattcacatttgtcacaggaacgatcccaaggtagcggaatgcataaaagattccatcgagttcctcagacctcaactggcgaaaggtctggacgagatcgagtcccccgggatcgacccgtttgtcctggagagggtcaccatatttgaatctcccggtagcaagggattgttcgcttatttgcagaatatggaggtccagggagcaggaaacttcaagatcaccaagttaaaattagatgtcgagggtatgacttacagactggggatacatatacctctcttgtacgttaccggttcctacaacgtcagcctgaacgtagtacaaaactccatcaaagaatatggggatttccacgcaaatatcagtgatattgacggccagggcgtgctgcaaggagccttggagggaaatcatctgataatgaaatcattccagttcaaaatcaacgtaggcgacttcgatgtcgacctaggaaacttattcgaatccaatccagtgattcgtcagatggctaacgatatactcctcaataacaaggcggaaataatgcgcatatccctgccgattatcgaaaggaaaatatccgaacacgtcttggacattagcaacaggatcacgaggaaccttgactacaacgaagtttttcccgcataaacctcacgcagttcaacatttttttattaggtttattgctaaaggacgtgtgctgtgtataaacaaatatcaattgttgatgttacttcttagaaatatagtaaagacgacagttaaaaaaaaacgttttttttgtaaatccacaaagtaattcaacgaaatcgataatttgatatctgggacgtcaaatgtctacgtaaaacagaaactacagatcttcagactataattcaagaatttaaatcatgttacacaatacaggacattgtttattgacgacaatcaaaacatgcat

SEQ ID NO: 36 - DNA, 2137 bp, Rhynchophorus ferrugineus
agaatgtttcaaaaaataactattgtatcgacgttcttggctttgtctttggcgcatcccaatgccgacacaaatgctactcccaaagagaacgaagtgattgtcaccacccccctaggtcaaattcagggttccataattcaatctagattaggtaaacagatttacgcgttcagaggtattcggtatgccaaggccccgacgaatgatcttaggttccagccaccagtccccgtagaaaaatacaagggagtatacaatgcgactgaagatgcgccaatgtgtcctcaaccgactacgtcccctacatctgaagactgcttattccttaacgtttattccactaagttacctcaagatagtgagaaaaacgtaaaaagacctgtcattgtacatattcacgcaggaggtttctatgccggcggatcacccagttaccttggaggaccgcaatattatatggatcaagatatcgtgttagtcacattcaattatcgattgggtgctttaggattcttagcaacgggagagaaagatgctccaggaaacaacggttttaaagatcaagtcgaggtgttgaaatgggtaaagcaaaatatagaagcttttggcggtgatccgaactctgtaacaatccaaggctacagtgctggcgccatcagtgttgtattacacatgatatcgcctctctcagtaggactcttccataaagctgctgctatgagctgctcaccgactgctcaatgggctattgggcatgatcgactggacttggcaaagaagcaagccaaaatattaaactgtcccgatgatacttcagcaaacatcgtgaaatgtctgaaaacgaagaccgctaaggagcttggtgattccctttcacaatttgcagaattcggagtggagcctgttctattgtggacaccagtaatagaaaaagacttcggtcagccaagattcttaaccggtcatcctatcactctaatacagaatggagaattccaaaaagtccccttcatcactggtatcacgacggatgaatttgcctacaaagcattcgctattgttaacaacgaaacgcttttgaatccactgaacgaaaaatgggaagaaatagctccaataatattcttatacgaacgaacaggagaccattcaaagactgtgagcaaagcattgaagaaattttatttcgaagataaacctgttgacaagagccttctgtcgaacttaggacagcttttcgccgactccactgttggttttggtgttcatcgagctgtgaagctgatcagcgaaaagaacaatgcctcaacttattattacaagtttagcttccaaggacgctatagccacttctacgctccagatagcaacggaactaaaccttatggtgttgttcatcatgacgatctgatctatttgttttatatatctaaactgttcccgtacttcaaagacaacaccatgaaagaagtggaaatggtcaacaaattgactattttgtatgctaactttgctaaatacgggaacccaatcccaactcccaacgacagattggacaacgttaaatgggaaccgtacaacgtaaagactcagaaatacctggatatcggaaataagctcaccatgcaagaaaaactgtacgaaaaacggtatgcggagtgggagaaactctaccctttagaaaaatacgcccaaattaagtaaatttattccgttaattttctttaattcattataatcgattgtataaaatactatcattattgctgttttttttttcatcaagaaagcaatgccctgtcaaagcagcgtttgttttaatagcgacttaagatattagatgagatttttatttattatgattttactaatatagattaggaagtacaattgattatattgaactaaaaataccaactggcgtgataagtatagcgcgacgatgatgaccatggctttaaaacaatggaacatgaattttgttattgctataacgcaatttataatttccgaaaaaaaaacaaaaaaaactcatcattagattgtaggtgttatcttcttaatgctgtaaatatttaatgatacacttataaaatacaacaaataaatgttttcgaaaataaaaaaaaaaaaa

SEQ ID NO: 37 - DNA, 893 bp, Rhynchophorus ferrugineus
tattttctacataaaccggaacatatagggaagattcttggaagtcacaaattagtaaaaaaggatgaactctataggccaataattgaatgtataggtgaaggtcttttaatagcaccagtcgaaaaatggcgcaaacatcgcaaaatgattatgccatcattccatcaaaaagttttggatcagtttgttgtagtatttgctgaaaaatcggacattttatacaacatcttgaataaacatgttgggatagaaataaatatgtatgatttgcttacaaaatgcacattagatacagtatgtgaaaccgcaatgagattacaactaaacattcaaatagaaaacaataactacagttacatatttgacaaaataatgttgctgacttatctgaggatttttcaaatatggaaccacatttattggatatggaattttttgggctatgagaaaaaattacaatcgtatctgaaagtatttaataatttatcgaataaagttattcaagaaaagctagaagaaagacaaaacaatgttgagaataaaaatgaggtaatactcaatggaggaactaagaagcgtatggcatttttggactatataatggaaaatgaaagctttacagccaccgaacttagagatgaagtcaatatgtttctttttgcaggaaccgataccacatcttctacgctgtcttttgtatttgctatgctaggaatgtttcaagatgttcaggacaaagttttaaaagaagtattagatgttattggacctgacagatatgcagaacctcaagatcttccaaatctacaatatacagagagggtaataaaggaaacattgaggttatttcctgtgggagctttttttgttagatcagtaacggaagatac

SEQ ID NO: 38 - DNA, 954 bp, Rhynchophorus ferrugineus
gccggtggcttgactcgacaaaattcattgggtgtcgatgcggtaaccaacaccgatcaggtcagtgggtcctagtcaagaaccatcgattgacaagtgcagatcactcgaaaatcatcgaccgataagatgaagacgttacttgtcgcttgttttctgttgggaacagttcttggcgagattccctcttacataaaaatatgcagcaaaaacaatccggacctagccaagtgcatcatcaactcggtagagaccctcagaccaaaactgaaagccggaattcccgaaatcaacgtgccagcagtcgaacccctttttctggacgccatcactctgaacagcggaccgaaccaggccaaaatcgatgccaatatcaccaacgttaaggtgcacggtgcctccgccttcgaaataatggatttacgggtaaatttgaaaaagaacaagttcatattcagagttaagttgcccaagatcgatttcgagggcgattacgatatcgacatgaacattctggttctgaaatataaaggacaaggaatcataaccgggaatttcactgactacatctgcgattgtacgatgaacggtcgaatcgaagagaaaaatggcgagaaacatctgaagttcggcaagttcaacatccagctctacctaggaaagagtaccatccatttggataacctcttctccgataatacttcgactttgtcgagggctaccaatgaagtggttcgtgagaacgccaatttgttcgttgaggaaatcaagccggtcctggaggactctttagccgagaaattttcggatattgccaatatcattactagtagatttacctacgacgaattgttccccgaaaaataagatgaattaggatattggcacgtagttaaccactgtgataattgttattttaccaataaaatgtctaacatgttaaaaaaaaaaaaa

SEQ ID NO: 39 - DNA, 1752 bp, Rhynchophorus ferrugineus
cagtgatttgttttgtagtggttatacatacttacatacgttgtagttaagtgttcttacaaataagatgatctggcttgtgttggctgtagtagttgccatcctgatttggtatactcttgataaaccgttgaagtattggtcgaacagaggtgttaaacaatcaaaaccatggtttatcttgggagacagttgggttaatttattacgaacaaaaagtttttgcggatatattgaatggatgtataatatgcaccccaacagcagatattccggtatttaccagtttcatacaccgacgctggttatacgtgatccagagctgattaaacaaatcacagttaaagattttgaccatttcacagatcacaggaattttgtcgaccctgaatccgatccattatggggcaagaatttgttctccttaaaagggcaacgatggagggagatgagggcgacgttgactgggtcttttaccagtagtaaaatgaaggcaatgtttagtttaatggatgcagcagccgatactttcgttaagtattattgggataaaggtgatgaaaaaatggagctggagttgaaagatacgtataccagatatactagtgatgtcattgctactatagctttcggcctcgaggtagattcactaactcaaccagagaacacattctatttgatgggcagaaaaataacaaatttttcagggtttgtaacgagtctaaagttttttggatactttatgataccatcacttttcaagaaattcaaaatatccatgctggataaaggcgcatctaattttttccgctctgtcattagtgaaaccattaaagtaagggaagatcaaggtattgtacgacctgatatgataaatgtgctactggaggttagaaaaggtattaaacaagaggataatagcgatataatcgatactgggtttgctacagtcgaggaatcaagtgatataacaaaattccgtcaacttaaaagtttaacaaatgacgatataacgtctcaagctttgatctttttctttgctggatttgatgcaatatcaacagccatgtgttttgcatcttacgaattggctgctaataaagatgttcaagatagactgagagaagaaataaaacaaacttatgatgagaataatggcaaactaacctatgaagctttgttaaagatgaagtatatggatatggtagtatgtgaattgcaaaggaaatggccgcaaggggcactgttagaccgtgtttgcacaaggcaatataccatcgaagcagaaagacccgatgaatcgcctctaaccattccagttgggcagctactgtggattcctgtttttggaatacacagggatccttcatattatccagatccagagaagttcgttccagaaaggttcagcgacgaaaacaaagccaaaatcaagccgtatacctatattccgttcggattgggcccgaggaattgtatcggttccagattcgctcttctcgagaccaaagttttattgtttaaaatgctattgaactttgagatcagcttgtcagataagatgcccgtaccattgaggttaagcaagggactcaatatttcggtagatggcgggttttggttcaatataaaacgaatttctagttgagtttgttgatttcaatgaaaatattacgatgtatctagtttaatgctaattgataataaagaatgtttgttttgtaaaaaaaaaaatttatttatttattattt

SEQ ID NO: 40 - DNA, 989 bp, Rhynchophorus ferrugineus
gtgacaaaacaatattttctatctacaattggtttatctccgcacaaaaggttaatttgtcagtacgagtcaatatattaacgagcgcgaaagttaaaatttactattaatgacgttacaacgagtagatataaattaaatcctaaaacattcgtcgtgctgtaaacagttgcgatcattcattcaatatcgcaataatgctgctcgtttttcttgaagttattttcgcggtacttgtggtgtattttagtctcaaattctggagagtgtataggattagaaagcaactagaatgggttccttcggctaaacgtttgccatttattggagcattacttgaaatgggaaatgactcaacagagttgatttataatttcacacgccttactgcaaatcctaaaaagagttgttacatcgagatagggtttgattgtgaggtgttaactagagatcatgattttactgagttccttctcagttcgaacaaattgatcaacaagtcctgggagtatcagatgttcgaggattggttaggtacaggtctattaacagctggaggtacaaaatggaagaaacgaaggcgtatcattacaccaggtttccatttctcgattttgaatcaatacattgaatcgtttgacttaaatggacgtaagctagtggaaatattgaaaaacgaaggcaccaaaccagatggcgtcgatatatattcatatataaccaactgtgcactggatattattagcgaaagtgctatgggcgtgtcggtaaagtcacaagaaggacaaaatcaacagtacgtcgtcgccgtaaaggatatcctatcctcgattttggatcgatcatttagtcttattaaatcgaacccttacttatttccttttactccggattattggtaccagaaacgtttggtgaagattctgcattccttcactaataacgtcatagagagccgactgaagagtctacaagaaaatggcggagtg

SEQ ID NO: 41 - DNA, 1790 bp, Rhynchophorus ferrugineus
ctgatatcaacaggatatgtggtgaaacaaaattagcctgtcgtttatataaatctgataccgtcagtagcggtagacgttaaggcgaatacagtaagggccacttttcaactcactcgtcttcggacgattttattgcgtgagacaccgctgtctcagttaaataagacgggagaagtgtgcggaactaaaataatacgctatgagctgcctttgttgggatgtgttgattgttcttgcggtgatatttttagctgtgtggctttatttccaatattcttatcaatattgggcatcgaaaggagtaccttatttaccgccaaaatttccttatggaaacaataacagaatattcttaaaaagcacggcttttgctagtgaagcaaaggattggtatgatgcgttcaaaaagcaaggccacaaatttggtggagtctggtcattttctcgtaaggttttggtactggtggatcctgagtacataaaggacattctcacgaaagattttcaatttttcattgaccgtgatgtattctccaacgaaaagtacgaccccaaaggtactcatttgttcaatatttcggaatcaggctggaaaccgttgagacaaaaactcacgccgaccttcacctctggaaaaatgaaaatgatgtttggcactgtgttgggttgcagtaatttcatgatagattttatgaagaagtcaacgagttcagggcttgatattgacatcagagaagttttagcgtcttttacaaccgatgttatatcgacagttgcgttcggagtggaaagcaacagctttgacgattccctaaacgatattcgtcgatatggcaggactctattccagaaactcactccgggactagctcttcgcgtatttctaggaagaagtttcccggaacttgcaaaaaagttggctacgaaaggtatgcgtcaagaaacgcaagatttttttgagatgatagtcaaatctaccattgattacagaagaaaaaacaacgtctctcgacctgatttcttacaactgctaatggacatgaatcaagaaccacaaaacagcgacaaatatgttagttttgatcaaatcgtagcaaatactgtactattctttatagcaggatttgatacatcatcaactacaatgacatttacattatatgagttagctcgaaaccaacaattgcaagaaaaaactcggacagaaatcgttaaagttttaaaaaaatatgatggtcaaattacatatgattctcttcgcgaaatggtatatttgcaacaagtagtggatgaagcaatgaggatatggccaccgctagtttcgttagggcgaatatgcaccaaagattacatctctaccctcggtattgggagagatcctgaatatttcccagacccagaaaaattcgatccggaaagattcagttcggaaaataaagctaaacttcatccctacgttcatcttccttttggtgaaggtccaagaaattgcataggtttacgatttggtctgatgcagtctaagattggcattatacgtattctaacgaattttcgtttaacaatcagtcctaagaccaaaatgcctttaacggtagatccgacgttcttcctgttgaaatcaaacgaaactctttatttaagagctgaaaaactgtaaaaatagtaaactatttacattattattggatgtatttgcaatagattatttaatactatatttaacagatatttatttaaatatattttaatattataaatataaatattatattaatatgaaaata

SEQ ID NO: 42 - DNA, 1252 bp, Rhynchophorus ferrugineus
ggatatatcataaatccatgtttattagattgtaataaaatatgtgacattactataacagcaagctagcatgacacttttcttttttaaaaatgttaagattctccaagaaaaaaataattactttttgggcaattttaacattcatgtatgtactttatgttgaagaatttttatatgcaataaatatgaaaaggtggcatacaatacaatgcaaagatgaaagggaatgtgtaagaatcttactagtagctgatccgcagatcataggaaatatgaatgaacatattcatattataacaccttttagtgtattggattgtgataggtatttaaagaagacatatggatttgcttatgagtttgttaaaccagatgttgttctttttttgggggatttaatggatgaaggacatgtagcagacgatgaagatttttacaaatatgttaagagaatatttgacatatttctaacaccttttaatatggatactacagtcaaacatatttggttgcccggtgacaatgatattggtggagaagacacaagaataacaccaaagaaattacaaagatttgagagggcttttccacaacccagtctacataaagtaaaaaatataacattttttaaaatcaacaggcttaccttagatatccctgtttataaaaaggacagacaattctatgatactagtaatatttttattggtgtcagtcatgtgcctttaatgttccttccatcaccctttgtcacaaaggtggttattgataaaatgcaaccacatttactatttactgcccacgaacataaaagtatgataataaacactgatgctttgttgcgtcaagactaccatataactccaataaccccagataatattcaagtatatgaatacagtttaggcataacagatttgtatgaaataatgataccaacgtcgtcataccgtatgggtaccaaaagtattggatatggtttcgctgtaatagaaaatagtgatttgaaatttacggtgttgtggtcgcctgaaaggctattttatctcgaaatatacgtgtttttatttggattacccattttattagtttgcctatctacaggctgtggctgtgttctaaaaagatctcgacattctcatattttcgtgattatttaattttgtttgcaataaataaatattacatttcgcaattgtgttatttaaacacttacctacatttgctgagagatatttcaatacaatta

SEQ ID NO: 43 - DNA, 2398 bp, Rhynchophorus ferrugineus
gaaaaagattttaatgtaagccactgttggacgaaactattatattacctttttaaaataatttgacaatcatttcaaaaatcgtcatttagacaatcagtatttcaatcgacaagatgatgaatcttttatggtgcgagaggactttatttataattttcttaagcaatataccagcactagcacaaagagaatcagatggcccaacagtacaagttcctcaaggtctaataaaaggtacatacgagaaatcataccggaatagaacatattcagcttttgagggcattcctttcgccaaaccacccattggaaatttgaggtttcaggcacctgtatcagcagatgcatggaacggtactttaaaagcaaataagaaatacgagtgcctccaatttataccattttcattattttttggtccaagaggaactgaagactgcttgtatatttatgtatacgttcccagagaaataataaactcgaatgaactggccctgagtttctaatggataaagatatcgtttatgttagtttcaactaccgattaaattcattaggtttccttagtaccggcgatgacgtgatacccggtaataacggtttgaaagatcaagtattggctatggagtggataaaagataatattaaattttttggtggaaaccctacttccattactcttactggattatcagcaggggctgccagtgttcattatcattacctatctccactttctaaaggtttgttccatcgagggctatctcaaagcgggacggccttgcaacattggtcactgaaactaaatccattggatgatgctaaaattctggcaaaaaatttaagttgcccaacttcatcgtcacagaaaatcctcgattgtctgagggaatgtgacgggaacgctttgatgaacgcaacaattagcttttacaaacacgtggatggtataccgttcaatatttttgggcctgttatagaaccgagatcagaaaatgctttcatcagcgagcatccatataaaattatggagaatggcaacatctatgatgtaccatggattacctcgaatacaaaagatgagggattatttcctgttggttttattttatggcttaaaaaacttcgactcttagatgagcaatggtacgatataatgccatatataatagaaaccaataataagttagataaaaacacagaacatgatgtattaagtaaaatcaaaaccttttactttaaagataaaccacttactgaagaaaatattcattccttgattgatctcttcactgaacgcctatttttaactgatgccgaggaagcaataaagatgcatacagctgctgtaagatcagaagtatattactattcattctcctacattttgaaaatgcctagctttccaccttcgaaagtgaaaggtacttctcatggcgatgacacaaggttattgcttggtatgataggaactcctagtaaattacaagataatgatgaacaaatgatggaattgtttacagagtttctagcggagtatgcgcagaaaggaataccgaaatttaacgacgtggaatggttaccacaagatcgacatgttgacaaactgaatattctatatattaataatgttaatgacattgaaatgagaacagtagataaactaggatttagtgatttttggaattctttaccattacttcaagtcgagaggactgtaagctacagtacagtcttaaaatgtagtttcgttttaaatgtattgtctttattaattttattcttataagataacaacataaacagcattatgtagcaattgtttaggtattatgttacattgatacatacaggaataaagatgggattaggcaattaaaagaaacaacatatttatttaaaaataacatctttattagaagtgtttagttatttcatttatgttacactgatgagtacatatgtatataaaacttaacaatagtttccactctacttgtaatttgctcttaagaaagccaatgtgaagaaaactccccctcctccgttcctaatagatgaaaatagtgtcacaaactttgagaacattacattattagctatttttgctttaatctagtgatttcattatactaaaatattttgcttgattcgttcagcatattacgaagttaaaatcaaaataatattaaaatattacaaataaaatcctaatctattcctattattctattccaatgttaaattaataaatttaaaacatttactgatactagcaatatattaaaaattagtaaatattaacaactaatagtaatgaattctgatattatataaaatgagaatgtttttattttgctgggatatatacgagataaaataaggtatttaataa

SEQ ID NO: 44 - DNA, 454 bp, Rhynchophorus ferrugineus
ggttccgttcttgcgatagtcaggcgacgatgttgttgtatgtagtcctggtgttagtcgccttcttgttttacgtaaaatttaaacaatcttattggaaacgccgaggtctacatcaactggaaccagaatttttcttcggtaacgctaagaaggaactgcttggtaaacgatcagtattccttctcttccgagatatttacgagaaagccaaagttctgaagcaggatcacctcggaatatacttcttcctggagccaatttacatcccaacgaacttgaccatcatcaaacagatattgataaaggacttccaacatttctggggccatggcggcttctcgcatcccaatgatcgtctgtcgatgaatctgttcagcttggagggtgatccttggcgacatctacgcaccaaactgactccaacatttacgtccggtaaaatgaagatgat

SEQ ID NO: 45 - DNA, 1304 bp, Rhynchophorus ferrugineus
cctataattgccataaaattgctgtgccacaataaaacaacacttagtaatttaattaaacatttaaaaaccttgtcctagccgctgagtaaatgagatatataacgaaaaatcgcactaggttcatactttatttgcagtggagcgtctcaaagaagcggaacggaaaaaatgactggaatatatggaacatatctaattcctattttgtacatttacggcgtttcttccgtacaattaccaaaagaaattcaaaaatgtgacaggacggcacctgattttaatgagtgtatgattaaaagtattaatgatgctctacaattatttaaaggagggtccaaagaatttggatttcctgtcctctcgccgttttatatagagagactcgagattaaaggtgatccaggaaaatcgttcacccttaatcagaaatacgataatctcataatgcacggcatgactggatcgacggtctcatcatttaacttaattgataatgaaaaccaatgtctttgggaactggaggttcataccgtgcaaacaagaatggaggctgactactcaatgtccggccagattttaatattccctatcaatggacatggaaaatgtaatgttactataagtggaattgttaacaagcatcgggccgactgcgaacattatatgaaaaaaggcaaacgccacctgcgactgaagaactacagcatggacatgtccgccaaggaatgtcatttcgattttcccaacatggttcccggcaacgaacagatttcgagggaagtcgagaagacggtgaacgagaactctcaggaggtcttccaagacgtgaagcacggcttcgaggaggtcctgtctagactgcacgagaacggggccaatagcgttttttccaaaatacccgaagatgaactgtttctgaagtagctgttccaatactattcgagatataaaattgttttaaatctatagtaataataataaatatataattttacaccatgtaaatatattgtaccaaaaataatcaataaagcatatttttaaatatatttactttttgtaatattttaaagtttctccaactaagagggctccaacccaaagtcctccatccggtcttgcacagcctggttactggcgtgactactgggacaattttgtgattgtttacaatttgtgattgttctagataagagtgtaaaatcggaaaaggaaaatgatcccagccacgccagtaaccaggctgggtaagaccggatgtcttctgggatgatttttgagttggacactcgtcagtcggt

SEQ ID NO: 46 - DNA, 2200 bp, Rhynchophorus ferrugineus
ttcgacgcggtggttctatgtagagggggacttatgtatcctttgaccgtacaaaaaaatgtttattttaaaatcattcgcgtgtagttgcccgtcgtaatagtgatatgtgctaaatagtggatagccttggctagttgacactgtcgtaacaaggagtatactccagggaggagtaaatttctaaaataaggaaaatatgaaccgcagagacaaaatattttcgctatttttaattttaattatatgcatatttaagaccgatcaagcgccaatacaaaatagcacatcctttaatttcattgatggctggaattataaattaccacagcataagtctcccctactaaaagaatcacagaaacatttcacaaatcctcgttatacatacggaaaagaattgaaaattgaaggatttaatgaagaagttattatttctaattcaactcttaaacataatgtttttggagcagacagtaaagatattattggattaaatgttagctgccctatatgtgaaaaagctgttcagtttctttacgctcaattacaattaaaagtatcctttgaggtcatcaagcaatattttatacttatctgtgctatatacagtagtacagaggtatgtggagggatatttgatagttacggaccggaattgttaccagttttgtcgatgttatcagatccagcagatgcttgtaaattattacttggtgagaaatgcaacgaacctgatattccagcacatcaatgggacatcacatttccggacacacctaaaccagaattaaaatataaagagttaacgaaggtgaattctccggttttcaaagtattgcatttatcagatactcattatgatccagactattttgttggatctgtgacgaactgcaaagaaccactttgttgtaggacatatagcaatttaagagatgaagaggaagctattccagcaggcaggtggggttcttatgagaaatgcgacgctcccaagattttattagaaaatatgttgaatcatatcgcattggagcatccagatatcgattatgtaatttggacaggagatttaccgccgcatgatatctggaatcaaacgaaaaattcaaatcttgatgttattagagatactgtagaaattatatttacagcgtttccagataaaccagtttttccagccataggtaatcatgaatcagctccagccggcaattttccgcctccttggatgcaagatgatacacactcaataacttggctctataaggaaatgactaatcattggttaagatggttgccagcaagtgcatttaacacagtcaaccacggcgctttttattccgtacttctgagacctggatttcgactaatatcactgaatacaaactattgttactcactaagttggtggttgttccttaacagtacggatccttcaaatgaacttaaatggttggtaaatgaattacaacaagcagaagataataacgaaaaagttcatataataggtcatgtggcaccaggtagcgacgactgcctgaaaacttggtcaagaaatttttatgaaatagtgcatcgttatgaaggcaccatcaccggattattttacggccatagtcacgcagacgagtttcaagtgttttacgagacaactaattatagcagacctacagcagtggcttatttggctccttcggttactagttttacaaattataatccggcctatcggatttactatgtggacggagaccatgaccgcactacgagggaaattatagaccatgaaacttggacttttgatttgcaaagtgctaatgatgaaggaaatgaaccaaattggttcaaattatattcagctaaagaagaatatgaaatgaatagccttagaccaaaggaatgggatttgttaataaacaagatgaaagtcaacgacaacttatttaaaagattttacaggaattattacagggattcacccacaatgccattatgcgatactgactgtcagaatcaaatactgtgtagtttgaaatgtgccaaatcacatagtaagacgcagctgtgtgcaaacacgatataaatatttactttattttttttatctaaataaacaaatttataagaacgctttttatgtattttaatgtagtcctaaatgtaaattatattttgtacagaatatacacactgg

SEQ ID NO: 47 - DNA, 3202 bp, Rhynchophorus ferrugineus
gacaggttcctgttgggtgttcttgacagtgtattgtttaaaaatttgtggaaggtgaaccgaagagaaagtaaaatacgcacgtgaatagaatattcaaatagttgcaaataagttacggaggcattactcacaccgtgccgagcctcacccactttgtgaattaaacaaaacggtagagtgtgtccgtggcggtggatggaattttgaaacggtcggttttataaggaaatttcgcatagttaatgtgtacggggcgacttggtcgggagtacgatgcggtgccgtgcgagtttcagtgcgcggattaagagttaacgatgtccataaacctctggcgaaattgcaagtttaaatgatcccccgaaaccgccatggctttcgtcgagaagtgtttctgctgcagtttaccgatagcctgcggatttttcgccgcgtacctgctgatcgcctacttgatagcttttgcctttgaactgatatggatcattctggagtcgtcgcataccttaccgactgccgcggttctgctggcgacagggtactttgccatgagtttgtttgcagccctgctgcttcacggactggccacgaaaaacatattttgtctggtgggatggatgttcgccgttaccgttctgacattcccggaggccggactggtgatctacatgagcgtcgactactggggaaccggccacatttacgggatgacggaactatcttgctggttgatcaggatagtgatcaacgtggttcagatcgttctcatccagtcgctgtatacgatatggaaggaggaggacatagtggataagcgtatgagggacatgtccgctggatcggccatgggcgaacccgtgccgatcctcaacagtcagtactaccagaataatggttacgatggatctctggatcaattaaacatgactaataccatgaagagatacggttcgatgccccacctgtggaacactgcaattcctaataacacgcctctgatgcagataccatacgcgggctatctatcgacagctagcgagttcaatgctagcgtgttcgttcccaatatggaccattcagagttacacgaaaaaaaagcacaatccttgatggacctccggttcctcgaccagcaagcacccatgacgtacgcgcagcaatggttgtcgggctcggtgaacgacaccgccagcatcatcgagccgaaacagagggccatgtccgagatccactactccacgctaccggcgaagatgtccaggtgtcaatcggtggacgccctcaataccgccaacaaaagcagtcacataatccggaacaggagcgggttctacgcccagcccatcgagaactacggagtgcctatttactacgggcccctggacggccccgacttcctcatctataagaagcggatggagaaattgactagcaaaaattcactcagcaacaactcggccgacgatgtacagaagtatcgagacgtggcgctgtaggtcagtttgaatgtgataaagtgaaaggacgacggttgctgacggctaaacgcggctactgacgatttcgataccgcctagtaatgtgtaccgtggacgttcgacgatatttggccatattttacttactaatcttgttatcatagcaggagaatcaacgaaacaacgacgattacctgtatacgtgttttattgtacttgttataatatttctttgttaaacaaaaagatttttattaacaactaaagttctttatttaatccgatgaggaaacccatgggggactcagataacatgaacgaactcagtacctgtttggtgtcgtcgttcacttgggaattggcaaagctgatgcacgagcagtatagagccacccaagcacaccacttcatcctcatcatcagtccacacatactgaacaccatccccataatattcatatagtctggtgtaaggtcttcaccattggcactgtttttaggagcgtaccgctgaatcttgtcagatcttcgtggatccgtactcatgatgcctccttttgttgaaaacgaggtgcggaaagtgtatttttatttcatcaaaatacaattttaaatggcgacgactaacttgctgttgacacttactgtcaaaacaccgttgcctacgacattcaagatagtcatatcacattccacagtagcattttaattgaagaaccgaaatcgaccgagtgcatttgcattttggctcaaccaatatttagaagaagaagaagagtttcgcaaactaaccgttctgacagtgaattgtgttttttgataaagttgtttagtaatcttttaagagaaccgctaattctagaaaaatggcaagaagatatgataccagaacgacaattttctcccctgaagggagattatatcaagtcgaatatgcaatggaagctatttctttggctggtacttgtttaggaatattagctaatgatggtattttactagctgctgaaagaaggaacaccaataaactgttagatgaagtatttacatctgaaaaaatctataaattgaatgaggatatggtatgtagtgttgctggtatcacatcagatgctaatgtattgaccaatgaactcagactgatcggtcaaaggtatctttttcaatatggtgaatctattccttgcgagcagctagtttcatggctgtgtgatgttaaacaagcatacacacaatatggtggtaagaggccttttggtgtttcaatcttgtacatgggttgggataaacattatggttatcagttataccaatcagatcctagtggaaattacagtggatggaaagccacttgtatcggtaacaatagttctgcggcaatatccagtttgaaacaggaatataaggaaggacaaacaacattgaaggatgcaaaaacactagccattaaagttttgagtaaaactttagacatggcaaagttgacgtcagaaaaagttgaaatggctaccttaacaagagtgaatgacaagacggtgattcacatactatcccctaaagaggtggaggaactgatcagtcaatttgagaaaagcgaggctgccttggaagcgtccaaaaaggagcaaaaagtcaccgcttaatttgattcattataaaacacatttacaatttttaattggctaataataaagaactatttctatttaaaaaaaaaaaaa

SEQ ID NO: 48 - DNA, 1342 bp, Rhynchophorus ferrugineus
catgcgatttcgcaatatttttcaacctcaatactgccgctacatctgttggatgccgccgactcgttgactcagaacgaaacagattacaagcgttcgatggctttctgcgcattcaactcgcacaaaagataaaacaaaatcatgaactagtggaatataaacaaaatcaccagctgagtgcttgttgtgtataagtgatcgacgtgaaggtgtgttttgtttagtggtgataatatcatataataacacacagtgaagtgctatagttcagtcaaacaatcgaagccatgggtgtttttcggcgatagctgggtgactatcttcaggagacaaagcttcagcgaattcgtccaatgggtctacaatatgcatcctaccagcaggtattctggtttttaccagttttacacgcccaccttagttctgcgtgaccccgaactgattaagcaaatcaccgtcaaggatttcgatcacttcactgatcaccgaagttttgttgatcccgatgctgatccattgtggggcaggaatttgttctctttgaaagggcagaaatggagggagatgagagcaacgttgagtggttcttttaccggtagtaagatgaagaccatgttcaatttgatgaacgaggctgctgataatttcgttcagtatttcttggacaaaaatgaagatctaatcgaactggaaatgaaagatacttatacgagatatactaatgatgttattgcaaccactgcctttggtatcaaggttgattcattgacccagccagagaatactttctacatgatgggcaaaaaaatgacgaatttctccggaattctgaccagtctgaaattttttggttattttctaataccatcgctttacaagaaattgaaaatatccattttggataaatcggcttcggaattcttccgaactatcataaatgaaaccatccacaccagagaagaacagggtattgttcgccctgatatgataaacatgttattggaagccaggaaaggcatcaaacaagatgataacgatacagctcaggataatcaagataccggatttgctactgctcaggaatcacatgatataactaaattccgccaacttaaaaacctgacaaacgacgatatcacctcacaagctctaatctttttcttcgctggctttgacacgatttcaacggccatgtgctttggttcgtacgagttggcagttaataaagacatacaagatagattgagggatgaaattaggacaacttatgaggagaataatggcaaaattacatacgaggtcttgttaaagatgaagtacatggacatggttgtgtctg

SEQ ID NO: 49 - DNA, 737 bp, Rhynchophorus ferrugineus
gtaattcatcgatatatcgaagatgtgatacgacaaagaatcgaaacaaagaagcaagaaagtttaaattatcacgaagataacactaacgataaaagtcgaaaaaagctggctttcttggaccttctactagaaataaaaatagatgataaacctttgtcaatggacgacctaagggacgaggttaatacattcatgttcgaaggacatgacactactgcaacaataatttcgttttgtctatatatgttggcaaaccatccatctgtacaagcaaaagtattagaagagcagcacgccatattcggagaagatttgaagaacgcaagagcttcatatttaaaccttaatgaaatgaaatatttggagatggttattaaagaaacgttacggttatatcctccagttacttttataggacggaaactaacaaaagatttagaattcaagggcacgttatatccgaaggacttgaatattttcttaatcatttattatgttcagctaactagtgaatactttgaagaacctgaaaagtttaatcctgatcgatttgcttcttatgataaaaagatgccctatgcatatacaccattctcagctggctccagaaattgtataggacaaaagttcgctatgttggagatgacatcagttttatctaagatagtgagaaactttgagttactaccagctattccatcccataaactttctctagccgcagagattctact

SEQ ID NO: 50 - DNA, 1066 bp, Rhynchophorus ferrugineus
ataaaagttacgtatatatacaggactagctggatcgagttcccagtgcaaaaaaacgcagcaagatggtaagcccactttttctggcttttatacttaccggtagtttcgtcataaacgatgacgtcaatcgctggttggactataagagcaattatcacttagatttttccgatttagaggaagagagatcgaggtttaatatttttgttgataatatacgatccattgaagaacataacatgttatatgaactttagtgagcaaatagttggttccttgctaatggaagaagttgatgatgaggaacgtgttgatatagttgctagtgctcctttatcaatagattggaccatcagaggaaaagtaactccagttaaaaatcaaggacaatgtggttcctgctgggcgttcagtgacgttggagcattggaaagtcagtatgctatcagacacaatgcacttgtacaatttagtgaacaaaatctattagactgtgctggttcattatataattgccacggttgcaatggaggtgatccttacaatgcttttcgatatatacgtgatattggaattgctcttgaaagaaattatccataccatggacgacaattttcatgtcagtggaacagaggacatttcaagattaggagctttggtatattggtaaggaacgaggtggctataaagaataaagttggaacatatggtcccgtttctgctacaatgaacgctgacgcgttgcacttttatcattctggaatagtaaattcgaacaggtgcaatggtcagaacaatcatgcaattctcataactggttacggaaattatggcggcgttccatactggaaaataaagaacagttggggaagaggctggggagaacaaggatattttcgtctgatttcgggtcgaaatatgtgcggcattaataattatgtcacctttccagttctgtagatataacgttattcaaagtactaacactatgtatatgttatttatcattatttgtcatataataattctcgttaataaaaaataattattagtaaaaaaaaaa

SEQ ID NO: 51 - DNA, 3140 bp, Rhynchophorus ferrugineus
acttattaaaccatttaatgtcattctgtattaacattgtcataaatcccagtaacctctggaaattcctttaatttacttaataatttctcataagtggcatactcaggctctgctaaatatacactcttatgtgggatgtactcaacagtggagtgcagaatattatatcctttactttctagaatcttttgtgcttccataaaattagttttgccacataaaaattcaaatacattttcatccactaatgatacttcttcagcattactatcaattgcatcttctgtagcaatttcaatctgctcattattaggctttgtagataaattggaattttcagcatgaataatgcctttctcttcaaataagtacacagcaccgccatcaccatatttagattgattcttccttaaaatagaagttatattttgctttatgatgtggagattattggtaaatatttcacaaagtaatatactagttccgggtccctttatttcaagtaaatgtaatttagcattagttttatcattttcgcaacttttaagtatattatttaatgtagcttgaggcatattaaatctcttacattgttctatgacttgggatagtttcaaattggctttaggatctaaactacctccttcttgtatagctacacggacctgcctagacaattttgtaaataagacgttcctctctgcatctttctgtccttttatgtgtcttatgtttgcccattttgaatgaccagcactccttttaaaaaataaattaaacacagttgactttaacataatgattaatttatttacagaaaaatagatttcctaaaattctaataccttatataacctttaaaacagcattaaagaatctacatcttcaaaaattatcggcaatagtatatattttcctttcattatcttcttagctttaatggttgattttgtatttccattataagtttaaattcgccaataaatgtgtgaatttttgatatatccgttttcattggtctcacatgtttagccctgtcaatttttagacttttttaaacggttaacggccattttgagcattggttttgggccgtcgtcttccgtcagaaatcgtttgttcgttttcaaagttacttgtgattcgtctattgttaaattcgtaatcatggcagacgaaaacagaattcgttccttcaagaacaaaggaaaggataccgaggaaatgagacgtagacgtataggtcaggcagtagaactgcgaaaagcaaggaaagatgatcaattactaaaaagaaggaatatatcagctgccactgaagagccgtcctcaccactgcaagaaaacaattgtcttagcccagtaacaatgaaacctgaagaaataatgtttggtatgatggactctgatgaatctgttcaatttaaagcaacacaagcttgcaggaagattcttagtagggaaagaagtcctcctatagatcaaatgatcagattaggagtagttccaagatgtgttgaatttttggggaagaatcacaatccaccacttcaatttgaagcatgttgggccttaacaaatatagcatcaggaacttcagaacaaactgctgctgttgttcaggaaggtgctattcccagattgcaggttttgttgaattccccgagattagatgtgtgtgaacaagctgtatgggcattaggtaacattgctggtgatggaccaataacaagagatatggtactcaattcaggaattttaccagacattttaaaacttattgaacccaacacaacattatcattattgaggaatgctgtatgggctatttcaaatctctgccgcaataaaaacccctcgcctgattttgaactagtaaaaccagcattgccaactttagcaaaactactttcatttgatgataaagatgttttagcagatacctgttgggcattatcatatttaacagatggaaataacgataaaattcaagccgtactggacactggtctagtcagcagattggtagaattactctatagtacagaaaatactgtgctaacaccagcattaagggctgttgggaacattgttactggaaatgatgttcaaacagattcggtaataaatgcaggtgctcttaatgtaatgaataagcttctgcaacatcaaaggttaaatatagtgaaggaagctgcttggacaatttccaatattactgcaggtaatagtgaacaaatacagaaagttattgatgctggtataataccagttcttcttcatgtactttcaacgggagatttcaaaagccaaaaagaagctgcttgggcagttacaaactacaccagtggcggtaatatccaacaattggcaaaattggtcgattttggggcaatcaaaccgatgtgtaatttgctaaacgctaaagacttcaaagtagtgtcagttgtactggatggcttgagcaacatcttagcagctgcccaaagaatgggagagactgataaagttggaatattaattgaggagtgtggtggcctggatttgatagaatcactacaaagtcatgacaatgaaagaatttatgaaaaagcattaaatatcattgaaaactactttagcgagggtcataatgatgatatgcagtctgctgtcactgaagatggtcaaatcacattcactaacatacttactcaaatgccaaatgatccattcacattttagaaaacagtgttcataatccatgagaatctcattattaaaaagaaaggataaccaaatctctgccattccaattctaggattgtttaaaaaatatatcgtaaaaaacactgtgatcgtctcttcaacataggctgtttttgtaattttttaaaggtacattcgaaagtaaggcatttcaggactttttatagtctttgttaatctcacatgaacgttctttgttaatttagttattttgttctttttttaattgtagctataccacacatttgtataatgcttgcgttattcctagtgcttttttcttaatgtttgtaactttaatatttaaatatattcagttttatttgttgtagtacttttttgtctttgatatacataataaataatgcttaaaactggaaaaaaaaaaa

SEQ ID NO: 52 - DNA, 1739 bp, Rhynchophorus ferrugineus
aggcttcactggaggtccgagctgcgggtcgtcgagcggtgcatagtttggcaggttcaaacatgtccgaaaacgtggtaattcttcactacaatgatgtatacaacgtggagtctcgacccagcccagaaccggtgggaggtgcggcacgattttgtactgccatgaaaagcttccagcatttgaacccgttgattttgtttagcggggatgccttctccccatctatgcttagtacttttaccaaaggagaacaaatggtaccggtactgaatgatgtcggaactcattgtgcagttctggggaatcacgattttgaccatggtttggaggtgttatctcaatgggtagctcagaccgaattcccttggctgatgtccaatgttgtggataatgaaacagggcggcccttgggagaaggccgaatcacgcacgttgtccactggtcagggcaccgaatcggtcttgtaggactagtagagaaggagtggcttgacaccttagccaccatcaaccccgaggaggtgacattcctagactttgtggaagctggtcaaaaactggccgctcaattgaaacaggagggctgtgattatgtgatagcgcttacacatatgcgcactccgaatgatattaaattagctgagtcttgcgatgaaatcgatttgattttgggtggacatgatcatgtatatgaaatcaaagtggtgaatggcaaatatatagtgaaaagtggaaccgatttccgccagttcagtaagattactatcaacttcgaaggcagagcaaggaacggcatgaaaccggaggtgactattgaagaagttaacgtaacgtcgcagtaccaagaggatcctaagctcaaagaaaaactggaaaaatatacagaaatcgttcagtctaagttggatgacgtcctgggttgtttctcggtacctttagacggtcgtttcacgtcaataagatcatcggaatcaaatttaggcaactgggtatgtgatgtagtactagccgctacaggagccgatttggtgatattaaattcaggaacgttcagatcagatcaagtgcatccagctggtgattttaccatgagagatcttaccaatataatacctatgcgagatcccttagttgtgttgaagataactggtcaacaggttctggagactttggagaatgcagtgtcaatgtatccaaaattggaggggagattcccacaggttgctgggattagttttgcgttcaatccaagcaaaccagcagggaaacgggtcgaagctaacttcgttagggttggcgatgaatatataaaactagaccagtattacagggtagctacaaagagttatatgcacagcggatgtgatggatatactatgttgaaaaatgcagaagtactaatcgacgaaggagaatgtccagaattaggtcttgccattcagaatcacttccaagcaattaatatgagactaggaaagaccaagaagcagtcaaaacatagacaatctttagttacattatcaagaaggcatagcttggtgaaaatgttggacggtagtgaattggatgggcctccacctttaagaagagctagcactatagaaacttcctcccataacaatgcccaccacggggccaaactcacacgtcgagcttccctagatgatttagaacaagaaacgtgtcaattaataccaaaaatagatcatagaataatagtgatcaatagcgaagag

SEQ ID NO: 53 - DNA, 4493 bp, Rhynchophorus ferrugineus
caaagcgatctcaaagtgattttttgcggtcgatgtgtccagcgtgtcagaattataaataaacaaactacgcagcctcttatttaaacaaattatatattgcgctaacgtgattcagaagcattcgacgttagtggtcggtcgtattatgttagagcaaagatgcttttaacgaagttgctgtttgtttctttattcctttgtatttcggtagtgaaggctgttgtatttatcaataatgccagtcaaagtgaaattcttgattctcacattagttcagttataaattatttaaatgctaagcctaataaagtgtacgattacaaaaaaggatctctaattcatattcaaaacagggctgacgtttttgaggtaactgttgcaattgatgtggactgtattaataaatatccagaagttccttgtaatgaaaaagtgcttatctgccacgcgttgattggacgcgattcagaacaaaatccaacctatcaagttcttagtgatgtaagatgcagtccaaagaatgatgaagaagtcacaaacatacctgttaacacggtggaaattacaagtaattcgccactgttaactgaaaatgtaccaaacaacaatggcaaaattgaattaagtaatgaagccataactccagaacaaatagaaccagatttcatagcaagacctaggccagagttatcttgcctaggatgccctcatgatttaaataaaaatgttgaaggcgtgacagaattgcttgaaacagctttaaggcatattgaaagcgaacaaactcataggtatgctgttgttgaagtgaaaaggttacaacagcagattgttaatggagtcaaatatattttacttattaaagtggttccaacagtatgtcagaaagatgcagatatttctgccccttgtccttcaaatacaaacgaaaatcctttcacatgtgaaattacttttatcgagcatccttggataaaaaaagaaaagcacattatcggcaacaattgtacgcgttctcaagaatttgctactgctagtaaatctacaaatagtggagatgacacgcaaaacgaaatatccaaaaatacaggtgcctcagttactaatcctgatcaatggttaactgacttacagtcgcaaattttaccagaaaatcctagtagtcctactcctaaacgcgataatgatgtgaaggctttagaaaattcattggctgacgaaggtaacaatcagtttttcactgatatacagtcacaaattttaccagaaactcgtgttatcattccaaggcaagatattgaaattagacgatcacaaagtatgccagcttctttaccaaatttaccttatatacctgaccagatttacgctcaatggccaagagatatacatattccaaagagacccgattttacacgttcccaaagtttaccagttgaatcactaacaccatttataagagacttcgatgagtttaaaagtcagcctctctattcacaacccaatccatttctgtatttgattcatatgcactatataccggagaaatcaacacagtatcatcaaaacgaagaactatctcgagagcatgagttgaatgtcggtcacattattcataatcccgattggatagaaatgcacgaggcccatcagagaagattaaggagaagtacttctaaatctgaatcgagtaataccgaagaaacccagcgaacacgtcgtgatatcgttaaaagttcagaggaaagttctgaaataagttcggaagaaattttggtcgataataacagattgaagagagaattgaatgattcaaatacttccagtgatgaatctacctctaaagattcaagcatcagtaatgaagttattaagagatctaagagagatattgtagagagtgaatctaacagcaacagtaccagtagtgaggagaacgggagacctaaacgaagcgctgaagacagttccgatagcagttccagtagtgaagaaaatgatactaaagcggccgacacatgccaaaagtgtaataataaagataatgaagattctagcagcagcagtagtagtagtagcagcagcaataaaaatgaccaagtttatgtccgaaatgagagatccacgggacaaatggaaaaaataagtcacgaagaaaagggcctcgtgagggacttggcatcttttgccgccgctacgctagacagtatcgatgatgaccaccataaaagagtaattcttcaaattctgggagcaaaaaaacttaaactggacggtctatattatcaaattattctacggctaggtatttcccactgtttcgaaggagaccatcatgagagttgcagagagaaattatttaccaatttaacaaagatttgcaaagttttggttcacgttgatgaagattattcgaatcctaaagtagtcaaatctcagtgtcagaatatcaagaaggacgaaaatgatcggaatagaacaaactacagtagatataaaaggacagctgaagctatggtgggagcacccagaccattttcaaaagactcccccaatgttcaaacttatctacaagctgctctggaacatctagattctacaaatagtgataagaagcatgaagtcgtaaatattgtatcggccacacatcaggtagtttctggagcaaaatatgtaattactgcagatattggattgtctgaaacaactcaaactcctaaaaggtgtgttgttgtagtttgggaacaattatggctggatagtagaaaatatacagttacatgcgattctgatgtatacaaatttaacacaaaagcaaaaagctttaagaaaaggtcgacgtcacttctaggtgttgataaagaaatgcctgttgaccacccagatgttagaaaatatgtggacatcatgatgcggtatttatcttcgaaaatttcgaaaaatactaaatacgctaacaaaagaattaattcggcatcaaaaaggattctgtcaggaacattttggaacattaacgttgatattgtacagtgcccaaaagagaaaacttgttctgataacgtgaattttattaactgtgacttagaagttctaaacagagtttggctacttgatagtctaaatatgcaacttacttgttctaacgatgatcacgtttacacctatagaaatgttactcctttaaaagccgaattggcttttactcggtttgtgaaagaatattccaaggattacaacaactatgaagaataccagtaccgcttaaaggtattcaagcaaaatttagcaaaaatccattctctcaataaaatggaagagggaactgcagaatatggcatcaccaagtttgccgacttaacggaggcagaattctcgaagctccatggctacagaccagatctgcagagtgagaatgagcttccttttatgaatgccgatataccagatgttaagatcccttcagaatttgattggcgaaataaaaaagctgtaacggaaatcaaagatcagggcatgtgtggaagttgttgggcatttagtgtaactggtaacgtcgagggccaatatgctattaaatatggtaaattattagagttttctgaacaggaactggttgattgcgataagtcagatcaaggatgtaacggcgggctaatggataatgcttacagagccatcgaaagtatgggtggattggaaactgagtcggattatccttacgaaggtgaagatgaaacctgcagacttaatacgaacaaaaccgtggtaaatctgaaaggagctgtcaacattagtcaagatgaaaccgacatggccaagtggttagttcagaatggtccaatttcaattgctatcaatgctaatgctatgcaattctacatgggtggaatatcgcatccaattaaaatattatgtaatccgaataacttagatcatggagttctaatcgtgggctatggagtacacacgtacaagttattcaacaaaacacttccgtattggatagtaaaaaattcttggggaacatcgtggggcgagcaaggatattatcgagtgtaccgtggagatggtacatgtggattaaatcaaacgccatcaagtgccatcgtagcttagatgttacataaatacagaacttaatttactactaattaccataaataatatttctaatattttatatatttttgacaaagaatctctagaaattgtgattttagagataccagtatgttatggtatctaataagatctatataatgtaaactgagacttaaccaaagtggcacccaaatttaagaaaaagattaattgtttttgatattactatcaattttacgatgtgatatgtatatactcataatttgactattatttactgattcatctaggaataatacaatagcttaaatgacatctgatttacaaacgtatatatataattggttttgtttgctgttgaaatatatttattcaaaaataaaaaaaaa

SEQ ID NO: 54 - DNA, 694 bp, Rhynchophorus ferrugineus
gtaacgatgttgagcttagtgttctctcttgttgctttggtgattctcggcagcgtagatgctgcgaagcctcttccgagttacattacagcctgcagactttcggatccggatttatcaaaatgcgcgattgaaaacgccaacaaagccataggtcctcttctcaatggagatgctgaatacaaaacacctaaacttagtccgatgaaagttccagagttgatccgaagaagcataaggtcgagatcgtcgtcaaggtgccgtggttgaacatcgacagccagtatacgataaccggaatgattctcattcttcccatcagcggaaatggaccggccaatatgacgttttatgacagtacttttaattatgccttcgactatgacttgtataagaaaaaggatggtaaagattatatgcgaataacaaaaacctatacggacgttaacatcgataatgcctatttccgactggataatttgtttaatggcaacaaagaattgggtgaaaacatgaatactttcttgaatgaaaatgccaaagatgttgtaaaagaattaggatatccggtggtacacaaactaatcgatttcatcgttcagaaagtaatacagaccttaattagagttgtgccttatgatcaaatattcctggtagaataaataattgttttgttattaaaaaaaaaaaaaaa

SEQ ID NO: 55 - DNA, 702 bp, Rhynchophorus ferrugineus
attatggcagcagaatttgcaaatggggtagttattggagccgattccagaacaactactggggcctatattgctaatcgcgtcactgacaaattaacaaaagtaacagatagaatttattgttgtcgttcaggatcagctgctgatacacaagctgttgccgatatagtttcttaccatttgggatttcatgggatggaattaggtgaagaacctttagtggaagtaggtgcaaatgtttttaaggaattgtgctacaattaccgtgattctttgatggctggaattctggtagccggatgggacaagaagaaaggtggacaaatttattcaataccgattggtggtatgtgtgttagacagccagtttcaattggtggctctggatcgagttatgtttatggctatgttgatgctaattataaaaaagacatgacccaagaagaatgtgttaaatttgttaccaacactttggctctggcaatgtcacgtgacggttcatccggaggtgttgtacggttaggaatcattaccgaaaaaggaattgagcgcagagttgtattgggaaatgaattaccaaaatttttcgaagcataatttactatcttatttttcatatataatttttactatctccatctttaagattaaggaaatttggttttgatagttaataaagtaaaataacgaaataaaaaaaaa

SEQ ID NO: 56 - DNA, 1450 bp, Rhynchophorus ferrugineus
agctacaataaattcaatggacaaaaaaattaaataataataaatggctttgttttactcaaggttaaaaactagtttactacagccctaaatatttctttagaagcacgtgataaatacaactgcgcagttaaatttctttgtttgaacacattattggagataaacagggtatatagaaaacaggcccggacggttccaggttcagtgtgttcactacaaggttagagagatattcggttgccaatttatacatcaaaatgaagttgttattcctcttctctgtcgttgttattagttgtcatgcagtgtccgtgttcgacctagtacaagaacagtggtcattttttaaggcccaacatgagaaagaatatgagagtgaaacagaagaacggtttagaatgaagattttcatggaaaattctcataaaatagctaagcataataaactctttgcccaaggcaaagtctcatataaaattggtcttaataagtatgctgatatgttgcatcatgagttcatatcaatattaaatggctttaacaagactaaaagcaataaattatatggcaacaagcaaaatgatgcaattacctttatcgaaccagctaatgttatactgcccaaatctgtggattggagaaccagtggggctgtaacccccgttaaagatcaaggccattgtggatcatgctggagttttagtgcaactggagcactagagggacaacatttccgcaaaaccagacagttagtatctcttagtgagcagaatttagtggactgttcccataagtatggaaataatggttgtaatggcggccttatggacaacgcattccgttatatcaaagctaatggtggtatagacacagaacaatcatatccataccatgctgaagatggagtgtgtcattacgaccccaaaaaaagcggcgctactgaccgtggctatgttgatatcccttccggcagtgaaacctccctaatgtctgctgtagccaccattggccctgtatctgttgcaattgatgcaagtcatgaaaccttccagctttactctgatggagtctattcagatccagagtgtagtgctgaacaactggatcatggtgtacttgtcgtcggttacggaactgaaaatggtaaagattactggcttgttaagaattcttggggcaacagctggggtctggatggttacatcaaaatagccagaaatagcaataatatgtgtggtattgccacacaagcgagctacccattggtgtaaataacttgtgataattatcatagcctgtaatagctgtataataatattttactgatagctttaggaaaatcagctctctgttattaatatttttatatcgatcttttatttttatttatagtactttggaatttccttaggtttaatatattactttggtaattaaaaaaaaaaat

SEQ ID NO: 57 - DNA, 2243 bp, Rhynchophorus ferrugineus
aaattgtcaaagtctatcaactggtcatcgtgaatagcatattttcaaattagaaatatatgaaaaaagaatggcctctgaaagatacagcttttctctgacgacttttagtccgtcaggtaaacttgttcaaattgaatatgccttagctgcggttgcagccggcgccccatcggtgggtataaaagcatccaatggtgtagttattgctactgaaaataaacataagtcaattttgtatgatgaacatagtgtacataaagttgaaatgataaccaatcatattggaatggtttattctggtatgggtccagactatagacttcttgttaaacaagctcgtaaaatggcccaacaatattatttggtttatcgtgaatctattccaactgtgcagttagttcaacgtgtagctgcagtgatgcaggaatacactcagtcaggaggtgttaggccatttggagtgtccttattaatttgtgggtgggataatgacagaccatacctatttcagtgtgatccttcaggagcttactttgcctggaaagccactgcaatgggtaaaaattatattaatggaaagacatttttggagaaacggtatagtgaagatttagaattagatgatgctgtacacactgcaatattaacactgaaagagagttttgaaggccaaatgacagctgataacatagaagtgggaatatgtgattctacaggttttaagaggctggatccttctcatgttaaagattatttagcaaatattccttaaatgttcttaattaatgtaagatatataaaatgtaagtcacactcttatttgaaataaacattcttttacattttaatagttacacgtcaaacataacattaatatttgtaatataactggtattcaaatatttttaaattaatacaaccattttattagttaattctttattattaaggcacacaaacagacaaaaaaattaacaaaaattggaagaaaatatatattcattacaaaatctatcccaatatttagaattgtgttattaatatgtatataaagatttagatataatctttagcacccaaaacctcataccaaacattgactttcaaactgcagttcagtcagaatttcaacaaattttgaaattcaaaattcttttccaatatttttggtatgaaacttatttggtaagtgtaaaatgtaatgaaattacattatattcacagattgaaatggtgactgaataatgctctgttttatacacaactatcaatatatctttttgatttacaaaggtcatacttaagtactgagaggataggcataatcagaattccagtccctttcaaatactgcctgcaactcgctacgtattgtcgtatgacttgcgttgcgctcaaataccggatcatgtaaaacaaacgacactccagcagtgtctgtgaaataatctccagaccagtttgatgttcctataaaagccgtattatcggtgaccatatatttattgtgattcactcgggcatatggaatttgttgctgttgtttgttagcaggtaccacaaagcgacggacttcaattgatacacgagggtacaatttatcaatactggctatgctctttaaaaagttatcctctgatggtctggaatgattccatttacttatgagtaatttaaccttgatattgtgttcaatggcggctgtttttaaggcatcatcgatcaccggccaaaatattctcttcggagtataaatcatcattgggaagtagtccatcacggcaatataaatgaatttctccgcgtgttttatcacattcaccaatgcatcaatatcatttgttctacctaccggattaaaaggcagtggagaacttgaaagatacgtttgaaaagtttcattgtcagagatcaagttcaaaggggtgtttaaattatattttgtagcaagggcactgggccaaaatggaggaatcttgctattttcttctcccaaagaccaataaacctcaaatatcttaccagcatcttctgctaaacaactacaattgtatacagctattcccatttctttaacctgagtaagcgatctccaatccatgttagcactaccaatatacaaatgtttcctatctataatccacatttttgtgtgcagcacaccgcctcctagtagtttggcaaaatttaaactcctaacttgtgcagctttccgtttaactaaaaactcggtatccaca

SEQ ID NO: 58 - DNA, 1113 bp, Rhynchophorus ferrugineus
ccgtcagtgtgacatgtaaataatttttgtttcagtattaaacatgtctatggaaatagataattggatagaagttgctcaacaatgcaaatatctaccagaaagcgacctaaaaaaactttgtgatattgttagcagtattctaatcgaagaatccaatgttcaaccggtctctacgcccgtaactgtatgcggggatatacatggacagttttatgatctagaagaattatttaggaagggcggccaagttccggatacaaactacatctttctaggagattttgttgatagaggttattacagtttagaaactttcacaaggttactaactttgaaagcaaagtatcccaatagaataaccttgttgagaggaaatcacgagagcagacaaattacccaggtttacggtttctatgacgaatgcatgactaaatatggaaacgtcaatgcttggaaatattgttgcagtgtcttcgatcttttaacagttgctgctataatagatgagaaaatcctttgtgtacatgggggtttaagccctgatataagaacgttagatcaaattagaaaactggaaagaaatcaagaaatcccacacaaaggtgctttttgtgatctagtatggtccgatcctgatgaagtggatacatgggctacaagtcctagaggagctggatatctctttggtgccaaagtaactcatgattttattcacattaatgcactcacattaatttgtagagcacatcaactagttcatgaaggatataagtacatgtttgacgaaaaactagtgactgtttggtcagccccaaattactgttatagatgtggaaatattgccagcatattagaatgttcctctacagaaaaaattgagccaaaactatttagtgctgttccagactcagagagggtgataccaagtaggaatgttactccatattttttgtaactgtcatcttttattattttattgttatcattcgatagctaaagacataccaaaccataacattgccttgtatattttattgtattgtaatagcctttaaaatatatcaatatagattttttccaataaaatatttgaaaacttattaaaaaatt

SEQ ID NO: 59 - DNA, 652 bp, Rhynchophorus ferrugineus
gacaggaaatgtttccaaattgaacgaagcggggaaacttgtcatttctcactacttggggccatcacccacaatttcggatgcagaacgtatatataaataccttacagagaaccattttaacagaccaattagacaaaccgttaatatgatgtccagatattccaaggtatattactatatgttttcctacgaaggaaatttgggaaatcccaatagaacagttccaggtgttcatcatgctgaagaacttagttatatttataataagagcagggcggtatccgaaaaggatgctttaacaatccaaagggtagtcactctgtggacaaattttgctaagacaaggaacccaacgtcatcaaatagaactggtgttcttcgaaacattaaatggaaaccgaacacgccaaataccaatgtcaaccaagaagtatgcttcctgaatatcaataagactttaatcatgcagaaaaatcctaaccaagatgaatggctgttttataaaaatatttatgacacttatggagatccatcctattataccacctactaagtatttattccgaactacattatattctttatattaagtaatttcattgtcttaaagttagttattcattagttgacagaatttacacctaacaat

SEQ ID NO: 60 - DNA, 1021 bp, Rhynchophorus ferrugineus
caatttcggatgcagaacgtatatataaatatcttacggagaaccattttaacagaccaattagacaaaccgttaatatgatgtccagatattccaaggtatattactatatgttttcctacgaaggaaatttgggaaatcccaacagaacagttccaggtgttcatcatgctgaagaacttagttatatttataacaagagcagggcggtatccgaaaaggatgctttaacaatccaaagggtggtcactctgtggacaaattttgctaagacaaggaacccaacgtcatcaaatagaactggtgttcttcgaaacattaaatggataccgaacacgccaaataccaatgtcaaccaagaagtatgcttcctgaatatcaataagactttagccatgcagaaaaatcctaaccaagatgaatggctgttttataaaaatatttatgacacttatggagatccatcctattataccacctactaagtatttattccgaactacattatattctttatattaagtaatttcattgtcttaaagttagttattcattagttgacagaatttacacctaacaatcacagattaataaaaatattacttataatttattttttggttaataaaatcaggacatctaaaaatatcaaaaaatatctttggctcattaaagagttcatgctgatataaattatgagtgaaggctcaaaccgagggaaatcagcatgattattgagcattgaaataataattgttatataactatatgtcaaaaaacgtggcaacattaagtttaatatgctcgactgagtgaatgagtgactgactatgaaatctattctaacaacgagttttacttccattaaaaaatggagatatttagcagaaatgtacagagatttagtttttttagttgcattattcactaggtttcagttgccgtatgtcgtttttagtcttcgttactatactttcggcatgaagataacttcatatgtttaaacttcctgatatctggc

SEQ ID NO: 61 - DNA, 2255 bp, Rhynchophorus ferrugineus
cgcacgccattcattgtgtttatatgacctttagctcagttttgctttaaccattgtgttgtgtagacatccaaattttatattatggataaatatacgccacaagaacaagcagaaatagtgacaatatttattgataatattcgttccattattgccactcagtggaaattgcgtcaatggtagcgggacctttgccctacccatgacagtcatgagtatctgcaaaggctttttactgtataaaatacagtttaaaaatgtacattaaacttagtgtatttcttattgcgtgtactacaacgatcacataatgtcaacagttctttagtagttctcttgtaagctttgaactttgcttagcattgcaatgtatcaatatatttctatgaagattgtgtattattactacaaaaacactgtaataattatataattgttactgaaaattttatgcaaacataaccttatcctaagagacactgttattctattgaactttctgtcgcagggcgtacctgaattaagaatccccaagttcgagccgtttgtcctgcccgaggtggtactgcaacagggtacccagtcgttgaatttcaaggcaatcctgaagaacatcgtcatacacggcctgtccaagtataaattcactagattcgattttgacgtccccaacctacaattcttctgcgatgctaacatcccgtcactgaagctcgaaggagattacgatgttaacggaaggatcctgatagctcccatagtgggtaaaggaagattcaccgccaatgtcgattcctgcgatatcaaaatgtatcaaaagtgtcgagagggtgaaatcaacggagagaaccacatcataccttatttcaccaacagtaccattgaggtcagcggacccatggctcatctggatggactgtttaatggaaataaagaattaaacgacgtaacgaacaaggccatcaatgataacgtcaacgaactcttcggggaactgaaaccggtcctggaagagacgataacccgcatcatggaggacctgctcctcaagcacatcgccaagaatatcccttacgactatttgtacccgaaataacaataaatatctttcacacaactacttaggaaacagttcttctatggagaagcgcgcaaacaccctcccgataaactccagcactgtcttgccgatggtctgctccacggtgggtctcagatcgttcaacagctcctccatgttcgcgttcagtatcctgttggtctgttcggtcagttccgggttgttacggaacagctcgtagaagtggaagttgggcttgccgaaattcatgtcctctatgacgatttcggacagtttcaggtgctgtttgtcctggttgaagtaacgttcaccgttcacggtagctatcactcgacaatcagtaatatttccgtcagctggtcccgaaccgtccaaattaaagaacaaaaccttcccgaagatcgaataatgggccttgatccgtatatgcgggaaggtcaggtcgaatttgatcttgttctggtccaggttgatgtcaaatcgtctaattacgaatttgtcagcgtcgtatatttcgacgttctcaaatttcgcgataaatcctgccccggcatcgatgcccacctcgggcaataccagcggatccatcttcggcagcctaaactcgggaatgcccgtcttcaggtggggcttgaccagctggatggctttgaggatgcatgtcgagaactccacgtcgctctggtggcatttctctacgtagctggctggaaaaaatccgtcctcattaaccgaccaattaatattcaaatcgtctctcgtcgttattggccaattaaaagaaataattattattatggctatatcggcgttgcccaactcgtatatgatgtgtggcgttgcgactgacgaatgtttttagtcaacaagggtcgaatgcggactgaaaatgggccggcgatgaaggtgctcgacggtattaagtaacgaattaacattgacattgataacgaagcccggtaattagaatgcaagcggcgccgtgtgttccgatacgcgttcgaacacaaaaaaataggaaaattctcgacaagcctcgtgaacggtcttaacgcaacactttgctcgaatcaccaaggtgatctcgttgaaatgcaattcggtcgaccatcattgacctggacattcgttgccatcgttaattaagtacacccaatgttcatgtttaagc

SEQ ID NO: 62 - DNA, 2255 bp, Rhynchophorus ferrugineus
gcttaaacatgaacattgggtgtacttaattaacgatggcaacgaatgtccaggtcaatgatggtcgaccgaattgcatttcaacgagatcaccttggtgattcgagcaaagtgttgcgttaagaccgttcacgaggcttgtcgagaattttcctatttttttgtgttcgaacgcgtatcggaacacacggcgccgcttgcattctaattaccgggcttcgttatcaatgtcaatgttaattcgttacttaataccgtcgagcaccttcatcgccggcccattttcagtccgcattcgacccttgttgactaaaaacattcgtcagtcgcaacgccacacatcatatacgagttgggcaacgccgatatagccataataataattatttcttttaattggccaataacgacgagagacgatttgaatattaattggtcggttaatgaggacggattttttccagccagctacgtagagaaatgccaccagagcgacgtggagttctcgacatgcatcctcaaagccatccagctggtcaagccccacctgaagacgggcattcccgagtttaggctgccgaagatggatccgctggtattgcccgaggtgggcatcgatgccggggcaggatttatcgcgaaatttgagaacgtcgaaatatacgacgctgacaaattcgtaattagacgatttgacatcaacctggaccagaacaagatcaaattcgacctgaccttcccgcatatacggatcaaggcccattattcgatcttcgggaaggttttgttctttaatttggacggttcgggaccagctgacggaaatattactgattgtcgagtgatagctaccgtgaacggtgaacgttacttcaaccaggacaaacagcacctgaaactgtccgaaatcgtcatagaggacatgaatttcggcaagcccaacttccacttctacgagctgttccgtaacaacccggaactgaccgaacagaccaacaggatactgaacgcgaacatggaggagctgttgaacgatctgagacccaccgtggagcagaccatcggcaagacagtgctggagtttatcgggagggtgtttgcgcgcttctccatagaagaactgtttcctaagtagttgtgtgaaagatatttattgttatttcgggtacaaatagtcgtaagggatattcttggcgatgtgcttgaggagcaggtcctccatgatgcgggttatcgtctcttccaggaccggtttcagttccccgaagagttcgttgacgttatcattgatggccttgttcgttacgtcgtttaattctttatttccattaaacagtccatccagatgagccatgggtccgctgacctcaatggtactgttggtgaaataaggtatgatgtggttctctccgttgatttcaccctctcgacacttttgatacattttgatatcgcaggaatcgacattggcggtgaatcttcctttacccactatgggagctatcaggatccttccgttaacatcgtaatctccttcgagcttcagtgacgggatgttagcatcgcagaagaattgtaggttggggacgtcaaaatcgaatctagtgaatttatacttggacaggccgtgtatgacgatgttcttcaggattgccttgaaattcaacgactgggtaccctgttgcagtaccacctcgggcaggacaaacggctcgaacttggggattcttaattcaggtacgccctgcgacagaaagttcaatagaataacagtgtctcttaggataaggttatgtttgcataaaattttcagtaacaattatataattattacagtgtttttgtagtaataatacacaatcttcatagaaatatattgatacattgcaatgctaagcaaagttcaaagcttacaagagaactactaaagaactgttgacattatgtgatcgttgtagtacacgcaataagaaatacactaagtttaatgtacatttttaaactgtattttatacagtaaaaagcctttgcagatactcatgactgtcatgggtagggcaaaggtcccgctaccattgacgcaatttccactgagtggcaataatggaacgaatattatcaataaatattgtcactatttctgcttgttcttgtggcgtatatttatccataatataaaatttggatgtctacacaacacaatggttaaagcaaaactgagctaaaggtcatataaacacaatgaatggcgtgcg

SEQ ID NO: 63 - DNA, 813 bp, Rhynchophorus ferrugineus
attccggtagtttatactatactttgtagttaagtgacttagcagatcaaattttggagatataaagcaattattttcggggttccaaattaaaacagaaaaacaataatgttcttaacaagaagtgaatatgatagaggtgttaacaccttttcgccagaaggtcgcttgttccaagtagaatatgccattgaagcaataaaacttggttctactgctattggaatatgtaccagtgaaggtgtagtattagctgtagaaaaacgaatcacttcaccacttatggaaccaacaactatagagaagattgttgaagttgataagcacattggttgtgctgtgtcagggttgatggctgactctagaacaatgatagacagagctcgtgttgaatgtcaaaatcattggtttgtctataatgaaaacatgagtgtggagtcttgtgcacaggctgtttccaatcttgctatacaatttggggactccgatgatggagctgccatgtcaagaccctttggtgtagcaatcttatttgcaggcattgatgaaaagggaccccaattatatcatatggatccgtcaggtacatttgttcaatttgatgcaaaggctattggctcaggttctgaaggtgcccaacagagccttcaagaagtctatcatcgcagtatgacattagaggaagctacaatatcagctttaacaatattaaagcaagtaatggaagaaaaactaaattcgtctaatgttgaggttatgactatgacaccaggaaatttgtttcatatgtttacaaaagagcaagtagaggag

SEQ ID NO: 64 - DNA, 1768 bp, Rhynchophorus ferrugineus
tgtagaattaaacgaatttttttttcagggccattacaaaggttaagttataaaaagcgtgcgcaattttttggttaaagaaatcatcaaataatcaaacaaataacgaaatcatacacatggagttagtttattttgataatactaagataatatattaatagatattttgcgctgtatacttgtttcctgcataggcttgtttgtatggagtactagtagcggttgtgtgtgtgatattcagtgataatgttgttatatgtagtgttggcgttggtcgccttcatactctacgttaaatataaacaatcttactggaaacgccggggtttatatcaattcgagcctgatttttttgttggtaatggtaagaacgagatattggggaggcgatcgattttccttctcttccgcgatatttacgagaaggccagagctctgaaacaggatcatgttggaatatatttcttcctggagccactgtacattcccacaaacctgaacatcatcaagcagattatgattaaggatttcccgtatttccagggacacggaggattcgctcaccccaatgatcgtctgtcgatgaatcttttcaacctggagggtgaactttggcgaaatcttcgaaccaaactgacccccacgttcacgtccggtaagatgatgtttgagactttggtatcgaaaaccgacggtttggagaaacttatcgatggttacatcacccgcaaggaaccggttgatataaaagaagccgcggctcggtttaccaccgatattatcgccagttgcgcgtttggtatagagagcgatgccttacacaacgacaagaacgatttccgggaattcggaaagaaagtgttcaaaccgaacccgctagttttgttcctcgccagtactgtaccggcatacatcctaggaccgttgggttttaggtttatcgctcaggatgtggaggagttctttatagaaaccgtgatgaataccatccaatatcgagagaaaaataaaatagtacgtaaggatttcatgcatctactgttgcagttgaggaacaccgaaggcaacaaggcaacagacgctcagactttgaccgacgatgaattaatagcgcaatgtttcgttttcttcctggccgggttcgagacatcctcaaccaccatcacgttcactctattggaactgggtttgaatcaagatattcaggataagttgagggcggaaatcaacgatgtcctggatcaacatgatggtcgtatcacgtatgaagccatgatggaaatgaaatacttggatatggttataaatgaaacgctaaggaagcatccaccagcagcaagcatatctcgtgtttgcagcaaaaagtatgaggttcctgggactggagtaacgattgaaaagggcacaaaagttcaaattcccgtctggggcatacatatggatcccgaatattatcccgaaccggacaagttcaatcccgaaaatttcagtgtggaaaataaagccaaacgaccagagatggcgttcattcctttcggggaaggtccacgcatgtgtataggtcttcgttttggagtgatgcaaactaaaataggactgatcagcttgctgaagaacttcaaatttacggtgaatgagaaaacacgcacacctattcagatggagaaagttagttttgttctgtctgtagaaggagatgtctggttgaacgcttcaagagtataacataattcatatatttcggtattttctttattattactgt

SEQ ID NO: 65 - DNA, 1942 bp, Rhynchophorus ferrugineus
aagtagaagcctttccaaacttaaaaaatgaattctactctagttttacaatatttattaacctatagtgggttgattttattgcttgttctatcggggatctatttatattttcaattttctttcacttattggaaaaggaagggattttcttatataaaacccaaatttcctctaggaaacaataactgtattggcttaggtgcattttcttatggaatcgaaacattggattggtataggcagttgaaagaaagaggtttgaaatttggaggagcttggaactgggccaatccggtgttggttatctctgatccagagtatgtcaaagatatactggtcaaggatttctcctattttaccgatcgagatttcttccataatcccattgacgacccaaagaatgagaacttgtttgttgtggagaaagacgagtggagatacatgaggcaacacttgtcgcataccttcacctctgctaaaatgaagatgatgtgccctggagtgctgaaatgtaccgaacccttgttggattatatgaaccagtgcgccgcatgtgggaaagatattgacgctaaggatatcatgtcagcttatacgatcgatgtcattggttcaaacatatttgggctggaactgggtactttcaaagctgaagactctaagttccgagagattggtcgtgaaatattccgcatcagtgttatgaaaggtgttaagactataatgacgagagtttccgaaggccttgctcgaactatggggatatcgattctaccaggagacataactgacgctttttccgaaatagttaaagataccatcgattataggataaataataatattaaacgacaagattttatgcaaatggttatcgatttatacatggaaactaaaaacagcgagagacaatttactttaaatcacctgatagctaacgtgatcgtgttctttatagctggttttgacacatccgctacgacacttcatttcgccttatacgagctggcgcttcatcagaatctccaagacaaagcccgagaagaaattgatagaatcttgaaaaaatataatggtgacctaacatacgaagcagtacaagaaatgacctatatcaggcagatattagatgaaactttgagactatatccaccgttaaatgttgttgcacgtgtagcagttaaaccatataaactaaaaaataccgatttatggttagagaaaggtagtagggtggttataccagtcatcgggtttcagaaagatcctgaatattttcctgaaccagagcgtttcgatccagaacgattttcagcagaaaacaaaagtattattccttcatatgtctacctacctttcggtgaaggtccaaggatttgtataggaatgcgatttggcagaatgcagagcgcaattggtttaattcaaatcttgaagaactttaaaatcacgttgagtcctttaacacaaacgcccatcaagccaaaacggggcgtatttattatgttgcccgatgataggatttatattaaggctgaaaagatataacaataatataagtaatataatgtaatcagataagttataattagttacagtgttttataataatagtactaacatgaactcgatgtggttcgcttcttattattaatctgcagggggtcgttctgttaattatcaaatatctcttaagaaatgctaaataataatatggtctaataagtaatttgaattttacttaccaaatctaaattaagagattggacctaaatggttaccaagtacatcataatgtgattagcaaagcgtgtgttacggggcactaaattgagtaatctacgctcagcatagagcgtagaacatggggcggcgtaatatatattgcacatgggtgtagaaacaactcaaaatcagcgtctgggtgttttcgtccgcg

SEQ ID NO: 66 - DNA, 462 bp, Rhynchophorus ferrugineus
ggagaccttgaagccaacataagtgatattcgcgctaatgcaaaattcaaaaccgaactctacgagaaggatggtacaacttacttaagacataaacatattaaattgaaagtacttacaggcaatggcaacgtcagacttgaggatatagttaatggtgatacagttttgttgaaattaattaatgatatcatcaataagaacctggaacgttttttggagcagaaggtattcctacgaatagccaatggtataatcgacaccttcacctacgatcaactatttcccgtatgagctaccgcaaatatgtatacatcattgtaattttaatgtacaataaatatttgttttatgtcgacaaaaaaaaaaaatttcgtcgaggttcaaggatgtcgggtttgtctaaatattaacgtgtacctgtgtggtctctaccaccttcttatgtttaaaatcggttgc

SEQ ID NO: 67 - DNA, 355 bp, Rhynchophorus ferrugineus
tgccgatggaaattacactaatatccgtactaccttggagctgaagggaaccaccttcaccaagaacaacaaggagtacatgaaatgggagaaggaagcgatcgacatcaagatcgagaagatgcagctgcaattcgaccggatcttcggcgacaacgaggagctgaaccagcagaccaatcgcgtcatcaacgagaacatcgatggcatcgtcggcgaactgcagcctgtgatagagggcgtggtggccgacttcgttttcggcatcctgaacaggattttctcgaagtactcggtgaacgagctgttcgtggactagacgcgcgcgagacgatatggtgagcggttagactgt

SEQ ID NO: 68 - DNA, 1040 bp, Rhynchophorus ferrugineus
gttgcattataatcatggtggtagtaatactatttcttgcagtacttggtttatttaatatatgtgatagtattacattcaaatattgtaagggctctgaatccagttcagatgcttgtttaattgatgctattagtgatgccctacaacaattaaaagcaggttataaagagtttggtttgaagggcttggatgtatacaagataccagctatttctgtggaagctggaaaaggggctgtacattttacacaaaattacaggaatatacaactcttaggtttcaccgatgctgttgtcaaagaagcgcattttgacagacaaaataatgcatttacattcactatgttcatacctctgttaacacagaaagcagattacaatgttaatggtaaattacttactctaccaatcactggaaatggatcttcagtttttgaattatataatatgaatctaaaaattgatatgactctagatgactacaccagagatggagaacattactacaaaattaaatcaatacaagtatacctacctatatctaagttaaaagggcattttgacaatctctttaatggaaataaattactgggtgataacgtcaaccgactgcttaatgacgaatgggaggctatatacagcgatgttcaacacccccttgaactagcatatgggaaagattttgaaatgtatattcaaacatttttggatcatgtgcctgctaaagatttgttttgaaaataaaataagaacctttcgaattaaattttaaccctgatcagtttcaagcatgtaatgatttccaaaaatagataaataaactatacaacatagttatctaatagttatgttaaataaacatgataataaagtttatgttcattaaaaatagattaaagttattttgtacttattgagttaacaaaaaatggatttcgacattgaactgtgaaagaaatctaatatgtttatataaggataagctttgatgacctcttttctatataccaacataatctattcccagctataattgtt

SEQ ID NO: 69 - DNA, 3872 bp, Rhynchophorus ferrugineus
aatcattaaaattaattaaaaccagttgaattcgcggcaaacttcattaaagtatgtgtcactctcgacgggacgacgtatgagtggagtcgtgcctgccggtcatttaaaaatatcgagtgattattaagttataaaacaacaaaaacttatattatggaaggtattttagcgaaactattagtgccaaatagcaacaccgtccacgagggaacgaaagaactcaaagaggccttcaagaaaccagaagctgtaccagcgatatgcgacgtgatcgtaacatcgacgaacccccaaatccgacaatcagcggctgttgtcctccgcaggagattaggcaaacgcagacaatggggcaaattgaacgtcgacttaagaaataggattaaacagggtatgctgcaggctttagttagcgagcaggagaaggtggtgaagaatgccatcgcccaattcattggcgtgatagggaagcacgaatttcgagataatacgtggcccgaggtcttacagtttgtgcatacgttgtgcagcagcgatactatagtagacaaagagatgggaatgtatactttatcgataatgacagaaatttcacatggttcatttatagttcactctgactcttttgctatgttatttacaactattttgactggtcttagtgaattgaactccaacttggcctactataccgtgctaacgatgagaaatctggtaccaaccatcagcggtcagcaacagatgataaacgcctaccatcaactgttacccaggattttggagatcatcaacgcgttcgctttggacgacgacaagcgggcttgcgacttgttcgaaatcctggaagagctgatcgaactggccatcactgtggtcgcaccgcatgtcaagctcatcgtggagatgtgcctgaggctggggagcaacaaccagatccccaccaccgtgcagataaaggccatcagcgtggtgggttggctgatccgtttcaagggcaaggtcatccagaagaacaagctggtcgagcccatcatagacgtcctgatacacctgatggcgcaacagcccgaggacgacggcaacgaggagtatttcttgggcgatccggaccaattcacgtcggtgacgatagccacccagacattggacctgatcgccctgcacatccccgcggaaaaggtggtgccgtacctcttgacgaaggttgagccggccatacaagggggcgatatctacgcccagaaggcggcctacttggcgttggcggttttggcggagggctgtgcggaaaggatccgggccaagtatctggagcccttcctcaagtgcgcctgcacggcgattcacaatccgaacgctgtcgttagaaatgccgcccttttcgcgttggggcagttcgcggaacacctgcagcccgacataagtcactacgccgccgagctattaccggtgctgttcgagtttctcggccaagtgatgcaacagatgcaaatgaaacaggagagccccagcttcgaccggttattctacgccttggagacattctgcgagaacctcgaggaccgcctgatgccctacctgcccacgctcatggaacggctgttcgccgctctagacccagccgccggtttctcgttccagctgaagcgggtggccctgagcgcggtcggtgcggccgccaccgctgtcaaggagggaatcgtgccctacttcccccgaatcaaagaactgctgaatatctacatcttggtcgaccccaattcggaaaaaagcgacgtgcaaagctacgcgctggaaactttggccgtagtcgcgcaattcatcggccccgaaaacttcaagccccacgcggaggagtacgtcggcatcgggctgaagctcctcgacgtgactcaggatcctgacctgaagaagagcatttacgccctgttcgccgcactctctatcgtggttaaggaggatatctcgcctattttaccgaaggtggtcaacgcgatgatcgagagcattcaaagcagcgagggcatagtgacgcactacgacgaagaagagaaagaggaaatcgatgtatatggagaaatatcagacgaagacgacgacgcagaggaggacatcgagggtgagtcttcagctagcgaggattcaactcagtgccgctactctgtggagaattcgtacaacgaggaaaaggaacaagcctgcttagccctaagggagatttgcattaacactggcaacgccttcctcccgttcatcgagaagagcttcgaggagatttttaagctggtgaactacccacaagacgacatcagaaaggcctctatcgaggctctgctgcagttctgcatcaccctgtacaaggcgaacacgccggagaccaaggacgcgctgtataaggcactccagatgttcataccgaagtgttccgagctaatccggtcggacgaggaacgctccgtggtgatgatatgtctggattcgtacgcaacgctgctggaggaggtcaaggccgacgtatttgccggtgagggtcatcgggaagctatcatgaactgcgtggtggacgtattgagtttgaagaccatgtgccaagacaccgacttgggtacgcggaccgagaataacgaggacatcgaggctgaacaggacgagctgttgttggagtctgctggcgacgtgatcccgaaatttgccgcggccatatcgcccgacgatttcgtctgttatttccccaatgtcttgaagttgctcgctaacagaacgatgaaacagaacagcgttagtcagagatcctttgccttcggcacgttggcggaatgtatgaagtccctggacgtttacgtggagaaattcgtgccccaactgttgaagatgtggctctccggggccagggaccccgccgacgaggtcaggaacaactccatttttggcctgggtgagatgatccttcatgggaaagacaaaattttcagtcattataacgaaatcttacaaggactgtcacaagccgtggccaaagaaacccatgcagggaccctggacaatatctgtggtgctttagctaagatgatactggtaaattctggtggcattcctctggatcaggtactaccaggtttacttcaaaaactaccccttcgagacgacttccaagagaacgaggctgtgattaaatgctttgccgcgctgtaccagcagggcaaccccgtactgaagcaacacttcgatgccgtgataaaagtggcggttcacgtgtaccacaacgaccaggtgccaaacgccgagaccaaacggatcctaacggaggtccttgggccccgaggcgatagccagcgtcgagaggctcttctcctagaccgcgcgggccgacagaaccaaccccacacacgcagctttaacagattcaaatccatacatggatatatagataaatatgtatcaggcatcgttttcattcagacggggattgatttttttaatattgttattgtggagattatttattcgttagttaagcgagggtccggtttcccttttcccagcccgggaaaagcgagttaaccgggttccggtcgtcgtcgtcgttccagacgacgggaatcaggtcgtttctctgtttgttcgtttttaagtgatgttgatgacgtgatggatcgctagagagaggtctttaatcgaatgttttgtgtcaaaaccgaggatagataacgagataccggaaggaaaaaacaaatcgagttgcctaaagatatatgttttagtttttttttataaagtaagtgcttgtgtaagcagcatcgatggttatattaattatactgtttttatattacacgttgtacggttaataaaatttttggtaaaaaaaa

SEQ ID NO: 70 - DNA, 287 bp, Rhynchophorus ferrugineus
agcgctatatggaaatttcgtgtggaaaagaaggaatatgtttatacaatcatggaatataccaggaccattcaacataccttttgttggagctgcatacaaatttatggttagacctgaatacatttacagtatattcacaaaattacaagaaaaatatcctgatggaggaaaattttggtttggatcgaaactggtttattttctacataaaccggaacatatagggaagattcttggaagtcacaaattagtaaaaaaggatgaactctataggccaataattg

SEQ ID NO: 71 - DNA, 738 bp, Rhynchophorus ferrugineus
atgatctctattccaataataggattacacagagatcccgtttactatcccaacccggatacattcgatcctgagcgtttcaatggagagaatacgattgaagaatttgcttatattccatttggatgcggcccaaggaaatgtatagcgtccaggttcgctttagtggaactgaaagctttgttgtttaaatttcttctacattttgaaattttgcctggcaaaaagttacagttgcctgcggaattggataagtcgtcctttaatctattaataaaaggaggattttggtttattttaaagaaaacaacaccataataataagtgtataataaattacttcagacagctaatatatttttttaattaagaagtatttgtttgttatattatatttagattttatttatattttaggtataacttttgcttcatttataatttgattttatatattttaacaattatacatatgttattaaaattagtttaagcatctgtgacattagtgttagtacctaatttttttttactttaaataaagatatcttgaagctttaatgaaatgaaaataaaaatgtctagacaatttgggatttggagcattactttgtcaactctggtatgctgatgcttctgattctaatctaattcgattttatctattaccctttgtgtttgttttattttgtttattctcttatacagaatatgattattcatatatatgacgcaaga

SEQ ID NO: 72 - DNA, 1058 bp, Rhynchophorus ferrugineus
tcgctggttttgatgccatatcaacagctatgtgttttgcatcttacgaattggctatgaataaagatgttcaggatagactgagagaagaaataaaacaaacttatgaggaaaataatcgtaaactaacatatgaggccttattaaagatgaaatatatggatatggtagtgtctgaattgattagaaaatggccgcaaggaggattgttagatcgtatttgcaccaaaccatatactatcgaagcagtaagaccggacgaaacgcccgtaacaattccagttgatggtctattgtggattcccgtttttggtatacatagagatcccgcatattatccggatcccgagaagttcgacccagaaagatttaacgacgaaaataaagtgaagatcaaaccgtatacatatattccgttcggattgggtccgaggaattgtattgcttccagattcgctctcttggagaccaaagtcttgttgtttaaaatgctgttgaatttcgagattagcttttcagataagatgcatttaccattgagattgtctagaggactcaatatttctgttgacggtggattttggttcaatctaaaacgaatttctagttaaatttgttaattatttatttagatgacaatgttactgctaattactgataaagaattttatatagtacgttgttaatatttatttgaaaataaaaaagatgaaaatctaaaaggattttgagaaatagaatagaataaaaattattaattaaatgaaccaataaaaaagatcaataaaaaataatcaataaaaatactatttttaaataaactaatttatgtatattatcagcatattattctcgttctatatctgttattttataaggttgttattttccgtttctttagcgttagttatgtaaaaagtttaatggtgtaaatagaaatagtagagaaatgtttacctttttcgcttttttattcttagctgcattcggcctcaagccaagtttttgcttgaattgtattttttcctttcaaaaaaaatattttatagactgttccc

SEQ ID NO: 73 - DNA, 2007 bp, Rhynchophorus ferrugineus
tgatcaagcgtaataaacccgagtatttgcgtcgatatgtgacattggatgaaacatggctccatcatttcattccgaattccaatcgacagtcattcgagtggaactgcacacgatgaacccgatccaaagcgtgggaaaatgcaacagtcggctggcaaagttatggcgtttgtatttttggatgcgcatggaataattttcattgactacctcgaaaaaggaaggaccatcaacagcgactatttcacaccattattggaccgttggaaggacgaaatcgccaaaagacggccgcatttgaagaaaaagaaagtgcttgtcagtgaaaacgatggcaaaaatccacgaattgggcttcgaattgctcccttatccaccgtattccccagatctgacccacagcgaatatttcctgttctcagatctcaaaagaatgctcgctgggaagaaattttcgtcgaatgaagaggtgatcgccgaaactgaggcctattttgaagcaaaggacaaatcgtactacaaaaatggtatcgaaaagttggagggtcgctataatcagtgtatcacccttgaagggaattatgttgaataaaaaaaaacaaattttgccaaaaatatgttttttactatggtaggcccgggacttttcagttgatatattaatatcttgtttttttttgaacaaccgtaatatgagggaaaaatatttatttcacttgaaaaaatacctgaaccttgtgcctctagattagaatatgttctgaagtatagaatatgaactgacaaggttactctaaaaaaaacacttatattactttaatctactgttaatccattgaaatagcattcgttcatagtcttgtcgattatagtgcacaaaattggaaaaacaaaattgtttgaaatagtaaatgaactaccgaacaaactgggtacaccttttggattctggacgggacatcaatattcgtacgtgaccgatgatgtggatgaagtgaaaatgatactaaataatccgcacagcatagacaagtcctgtatttatgagcaattacgatggttgtttggtaacagtctacttgtagttgaaggtccccagtggaaaactcgcagaaggcacttcgtgaaatcatttagtccatcgatcttgaagtcattcgtcgaatttttctatacgaacagtacagctttggtcgatgctttgaggaaaccagatcgtccagacctgtatattacttttcagaactacagcatagatggattctgcgaagccataatgggaagaaattataatactcaaaagaaatcagaatacagtatcgtagaggacctagacaggttacaggaaatctgtagaaaacgctgtgtctttgaagttttcaacctcagcgtcgttatatggggttttattcacgaaggactgaaaaccctcggatatttgaaagctgtcagcgaatttgtgaatgttatacttaaagacaaacgaagagatttcaaacagagtccagtcattgctgacaccacactgaaaattgcggacaccttgttgaatggagacatgaaattgacggataaagaaatcgaagacgagataactttatttttgtctgcggcttcggacactactgggacaacgatggcatttatcgtaactctactcggaatgtatgaagaagtacaagaaaaaatgtacgaagaagttatgacctatgttggagataaagccatcggacctgaggacttacataacttgaaatacacagaaagagtgatactggagtcaatgaggatcctcccaccaatccccacagtggggcgacacgccaaacaggatattcactgtggttccaaagtgattcctaaaggcgtcgacatatacataaatatcataaaacttcatcgtaacgagaagttttggccagatccattacggttcgatcctgatcggtttttaccggaagaggtcgctaaacgaccaaagtattgctatattcccttctccgc

SEQ ID NO: 74 - DNA, 974 bp, Rhynchophorus ferrugineus
acaaatgcgtcgaagccaatatcgaagccttaaggcctaacttgaaggaaggggttccctctttgttcataccggccctggatcctctcgtaatacccccgacctgtgtcaatgaggaggatcaagtcaaagtcaccttcaaggatatccacatctatcatgcgagtgatttcgctctggatcagttcgatatagacttagtgaatcatgaagtgaacctgaccattgtcttcccacttttgaggataaaatctacttacagtgtgaatgggaagttcttggttgttactttcgatgaaagcggaccagctgatggaaattacacaaatttccgagttttccttggactgaaaggcagcccctacatcgaaaacggagaacaacatttaaaatgggagaaagaaaccatcaacactaccgtaggtgaatcccatgtagtactggataaacttttcggaaaccataccgacatcaccgacaaaacaaacaatttaatcaacgagaacattcaggtcatcatcaacgatctgcagccggtaatccaaggcgtcgtcagcgacttcatcttcggtatagtcaacaaactcttttcttattattcagtcaaacaattgttcgttagttaagttgtgatcttagtcttagtcgtgaaataaagtttacatttaagtttatgttgttcgagttttttatcatttatgtctccgaatattttacgctgaaaactgatcaaattgatgatggccaacatgtttcaagaaaactaatgaatgagtattcaccaccatcgcatatggcaagccaccaccattgagaagaaccattttttgaaaaagtttgtttgtgttgtcctgctgacaatggggcattaatcatcttaaaaaatattgattggcatcattaaataacattcaaataatagcagaataacaaaaagaaatgtatgatttttttttgcaatattgtatatacac

SEQ ID NO: 75 - DNA, 2773 bp, Rhynchophorus ferrugineus
gcgaggtgtggtgtctctaggaaatttaatcgaacatcacgtcgttgtccgaaatttcaataggatcaaaaaaataattggccaagatgggggccatgttccggagtgaaaaaatggcgttagcccaactgttcatccagcctgaagcagggtaccacgccatatcagaactgggagaaactggatgtgtacagtttcgcgatttgaacgaagatgtaaatgtatttcaaagaaaattcgtggcggaagtgagaagatgcgatgagttggaacgtaaactcaggttcattgaagccgaaattaaaaaagacaacgtcaggataccggatgtccacgagatgcccaaggctcccattccaagggaaatcatcgatttagaggcccatcttgaaaaaaccgagagtgatattaagcagttgatggaaaattccgtgaatttgaagtccaactatctggaactaaccgagctcagacacgtgcttgagaagactcaggccttcttcagcgaacaagacgaggtcaatggcttcgattccgctcataaggccttaataccagatgatcacaatatttccgtgagagggcgtctaggattcgtagctggggtcatcaacagagaaaaagtcccctcctttgaaagaatgctctggagaatatctagaggaaacgtattcctgaaacaggcagaaatccagaatcctctcgaggacccccagaccggcaatgagcactacaagacggtgttcgtcgccttcttccaaggagaacagctcaaaagcaggatcaagaaagtctgcgctggataccacgcctctctgtatccatgccccaatactcaacaagagcgagtcgagatgttaaaaggggtaaagacgagaattgaggatttgcaacttgtgctcaatcagacccaggatcaccgtagcagggtgttgaccagtgttgcgaaggagctccagaattggagcattatggtcagcaagatgaaagcaatttatcacactctaaatctgttcaatatggacgtgaccaagaagtgccttattggggaatgttgggttccgtcaaaagatattcccaacgttcagaaagctctagctgatggatctaatgcctgtggaagctccataccatcattccttaatgttatcgataccactgaagccccaccaacatttattagaacaaataagtttaccaggggtttccaaaatttgatagatgcttatggtatcggatcttacagagagtgtaatccagcactatacagtattataacattccctttcctattcgctattatgtttggtgattgtggtcatgctatcatcatggcactatttggattatggctggtattggatgagaagagaatcgctgccatgaaaaacaagggagaaatattctcaatctttttcggtggtcgttacatcatcctcctcatgggtatcttctccttctacacaggattcgtatataacgatatattctcaaaatctatgaacattttcggtaccagttggaaaataaatgcttcctatgatgaaatacataaaatagaggatttacagatgacaccaagggaacattatgtggggacgccatatttcataggcatggatccggtatggcagatctccaagaacaaaatcatctttggtaattcattcaagatgaagctctccataatattcggcgtggcacacatgatctttggtgtctgcgttagtaccttcaattacgttcactttaagcaacacgtcaacttgatcctccaattcatcccacaaatcctgctgcttatgttcctgttcctgtggatggtgattatgatgttcatgaaatggatcctctattctggacagaatgatggaatcgataccaagtttggttcctcgtgtgccccgtccgtccttatttacttcatcaatatgatgttgtttaaaaacagggagcccgttgaaaattgtgacgagtacatgttcgaatcccagggagacgttcaaaggattctggtgacgttggccttgatttgcatcccgtacatgcttctgggaaaaccattgtacattatgttcaacaggaagaagtctgatactccccaagtcaacggtaaaaggaacggggatgtaaaccaagggcttgaaatgaacgagataacagagaacgggtctgaaggtactgttcagattggccagacccaagtcggtcatcatcacgaggaagaagagcacgaagaggagccgatgggagagatttgggtgcactctgctatccataccatcgaatacgttctgggtactatttcacacactgcctcgtatctccgtttgtgggccttgtcacttgctcattcccaactctcagaagtattatggaacatggtcttccaaatggggttaaaaacggacggtttttcttgcatacactacgtcttcactgggtagagttcatgtccaagttttacagcggtgagggatacgcctttgaacctttcagcttcaaagctatattggcagcagaagaagaggccgcggaataatagagctagacggatgcagacgaataaattacataatatttttataatcgtctttatagcgttcgattttatttgtagaactttgttcgttgatttatcgaaattttattgaaaaatatgtagtttgttggccgttaggtcagtgtaatttacagcatcgttttattttaatagatttctctttattttagacaaatatattagaatttgttgcaaacaataaaaaaaaaa

SEQ ID NO: 76 - DNA, 6459 bp, Rhynchophorus ferrugineus
gtcccgtcgccgctgccggcgaacgattcgacgcggtatcgttgcgcacagtcgcgagctctggctgggtctacgcgctcgtcgctccatcttgagtagaattatagcttgtgtacggtgcgagtgtatttagtgcgaacaaaatccgatgtttatattttgaagtgtacaaaaccggaatcaagaaatgtcttcgaacaaccagaagctgtcgaccactcaacgtatgatacaagctgtaccgtttcccccgagccataagttgacggtggccgaagttttcgatccgaagactgcgaaacccaaacccgacgttctcaagcagcacttcatcctcgaaggtcgcatcgatgaggcggcagcgttgcgcatcatcaatgagggtgcgcaactgttgcgcgccgagaagacgatgatcgacatcgaagctcccgtcacagtatgtggcgatatacacggtcagttttatgacctcatgaaactattcgaagtaggtggtccacctgccagtacaaagtacctttttcttggtgattacgtcgatagaggatattttagtatagagtgtgtattgtatctatgggcattaaagttatgttatccaactacgcttttccttcttcgaggaaatcacgagtgtcgtcacttaacggaatatttcacttttaaacaagaatgtaaaataaaatattcggaacgagtttatgacgcctgtatggaggcattcgattgtctacctttagctgcgctcatgaatcaacagttcctttgtgtacatggtggtctttcaccggaaattcacaatttagaagacatacgaaagttagatcgatttaaagaacctcccgcctttggtcccatgtgcgaccttctctggtcagatccactcgaagatttcggcaacgagagcaacgctgagcacttttcacacaattctgtcagaggctgctcatatttttacagctacactgcctgttgcgacttcctacaaaataataatctgctttcaataatcagagcgcatgaagctcaagacgccggataccgaatgtacaggaaaagtcagactactggttttccatctttaataacaatattttcagcaccaaattatctggatgtttacaataataaggcagcggtactgaaatacgaaaacaacgtgatgaacattcgccagttcaactactcgcagcatccatattggctgcccaacttcatggatgtctttacgtggtcgctgccgttcgtgggcgagaaggtgaccgagatgctggtcaacgtgctcaacatctgctccgatgacgagctggtctctgatggcgacgatgccctcgaagaagccaacttaaggaaggaggttatccgtaataaaatcagagctatcggtaaaatggctcgtgtattctctgtattaagggaggaaagcgaatctgttcttcaactcaagggtcttacgcccactggtgcattacctttgggagctttgtctggcggaaagactagcctcaagaatgcattgcaaggattctctcccaaccacaaaatcaccagttttgcggaagcgaagggtctggacgccatcaacgagcgcatgccaccacgcaaggacgcgccaccatccccagcgacggaagaaccggcacaatcgcaggaccacaaccatacgccgcaggccaacgcgcactcgtgagctccgcagcgtgagctcgcctagggcgtggcctcggctgcacctcagctctatgccaactgcagaaaaacatgtgatggttcgatgcgtcgatcaatgcagtggctatcacacctacacgttgcatcattgatatattacaaaccacaaaacactatattattggacgacaggttcgttagccaagactctaaacggaatcaagtagctggtctgcttcaactgtcgcgcccgtacgatctactgtctcgctcttacacactgctctactgctctaaactaatgtttctttccctctcatagataataggtacaacataactggtttccaccgtttcatttccccacttctaaccggaataccgccattaaaacggtgtttcaaattaaaagtcggcttgcagcaaaaagtgatccggtggaaacttccggatagttgtttatttcaaagtatcacgtaaaaactacattccatgactactgggttattaaagcacaccatcctttagatttctacttactattgatgttattgtctgaataaagtatattgatattgtgaccagtagagtctgtagtgaaaataacctttctctgattttgaaaataaatataaaatccaagggaattattagttttgcaaatactatttttgaagaactacttatacatatagtatttttgtaatctgaacgcagatgaaaacagagctggcccatcacctctgttgtcctcgtaatgtcaatgacaattcattattaagaaacatttgtccacactgctttttagttgatataaatatcgaaccgtaagtagttttccaaaaaaaaaagagagaacgatcattggtcaatttgacagttgaaaatgctacgccacaaagcgcataattgaatttcagtcgttttttcaactgtcgaattatctcgttctgtaaaaagcaagtgaatagcggcataatcgtgctcttgcatggattttctttactaagtatgacacaaggctaatatgatattttttggcaaaaacaaaacttattgaaaagagttaataataatgttgatatcatggaactaataaccactgatatgtcaacaattattacatcgtatctgatgacgctgaaaattaaaggaaataccaaaattttgaaaacatatatgtaggtcatttaattcaaaatccatgtatgaaatgttgttagtcgctgtattaataatgtcaatcagcagtgtgtaacagcgagctggctctagctgtacgcacgtgttgagtgatataagcgtgccataaacctcctgtcgcctcaattttgtcatcgtgttcatccaacttgcaagacgtcgtactcgtctctactttgtgtgttaatttaaagatacgtcgcttcagaactgtgtggtttcttcattcggtttggtaataataataatagtaacagacaattgcagtactaccttcagtgaaacatgtatgcccccggcagcattgcaagataacccgaaagtaaaatgaaatgaatcaaaattgtataataaactgttttgtctattaccaaaccattatatacatatatagggaataaagaaagaataaatttatctctctattactattattaaaggacttttgaattctttaattaacacaagacacatctttactacgagttgtacttattgtttttttttttctttttgattgtacaaattgtgttatactattatatggttaaatattaaaaaaaatttggccgggcatttggaagagaacaagcccccaagagatatgtatataagtgtacaaaatatatgttattcaataaatgttaatccacttttaaaagaataatgaatctccagcactataacaatctaggatttattagtaaaattgaaaggggatgcaaaactatattattctttctctttcccaaaagctccggctcggtatgaatgctaaaaaatgttttttgttgtaaaagtgcgaatgttaaattatgtatctaataatcttattctgtaaattttctctatattatatacaaattaatataaaaattatagttaattattaggtaatatctcaaaaaaaacaactatcggataatatttagaaaattatcaaaaatttcatatggcgtcccttaacttttatacaaaataataaattttgcttactggcatttaatatggtttgatgtatgtactggctaccacactttcccacatccaagcagtacaatttgatttgctagctatatctaaacacagaaacagactgaatataatgtaacctaccttcacataatatttaaacatcaaactattgtcaaacatatgtcagtctgaatgttactagaattttttaacattttgtcgtcttcgcgtaagaactgtcaagctcttctttgacataatacagcaggtgtagctaacaaataactcagatttcaatgtacaattgtctaagggttgttcaaacttatggattaggcttcagactcataagcaatactaagaaatctctaaatatgcacaaaactatttaaatgtgaagatactttatataaggcacttaattcgattctagtagaatatatagttttaaatatcgttattcgtaactattaacagccaaattgttttgtcgagaagtgctagtagacgctgacaatcaaattcccgaagaaaaaacttggaaagtaaaaatggggccactttatttttggaaaaaccctcagacatcaactataaaattcatagattcaaacgtttacctggtagctctcgaaaatgccgattatttaccaaactttatattaagtaaattaactaaaatatatatttcaaactttgtaaataataaattctttatataccaatagctcttaacttggttttcgcctttatacatatatatatataaataaataaaatgtatttcgccgataaccacagttttagtcttagcgtatatggtcatattttaaccgtttaagaaatattaagagatccgctatatgctctgggactaatcataaataataacaagaactaattaataacggataaagatgaaagcagtgcgcgaagaaaaaaaatagcgaagatagtttataaattataaaagtactttttactcataagtgtaattttaaggtgtggtttgacgcgaaatcatcagatcagtgttatatcacgtaaggatatactaattctaaaaaaactgtttcaatatattattaatttaaaaaatggaaaatctctttttacttttaaagtagtagaggtggtattaaagtttaaggcatcttttcgaatgtgttaaaaatatatttggcgatgtatttaccaaaatgaaaatgaaaagcatctagtcaactacaaatctttaatgcgtcaaccaacaacgctaaatatgattaaacaacattgatcagtttgcttgaattactctatgatattctctaattgctaaagaaaaatatgcacgctattggccaataaattacagatcgtaatgcgttggtgatacatcctaaaatatagttttaattttcaaatctatatatagattataacctttagttgtgtcctgactgaatacatttgttatcaattaattatcgtggtttatttttacttttttagttgagatttcgatatatcggaattaagccgtttcttcattcgtaagaaaaatgttacatgtatctttctttggcagatatagcgcgtgttgccttatatcgagatctaagcttttcgatttgttgctaatgtaccgaaatgtaaatgttgaacattctcccaccacatacattgacctatttaggtcgggcgattatttgtgatagctatccttcattttgaatagctttttagttattttcgttatatcacgttggagcttcgttgtctagggaactgacatgtcaggaaaactcattaacttaaatgacaacaacacaaaatcaaatgagccatgcttgcttattaaatcgatccgtgtaacagctccagtatggtataatcagaaataacgtacttttgaaaatgaaagagtttaaaaatgtataaatataaatctatctatatgcctttatacttcctacctataattataattatgcactgaagtattgggatgttagacttttaatactttagtactatcactgtgccacttttgttggctgttttaagattaacattagtactggaagtccagataagcaactaaatacatttttgtcaaacgtaccaaggagtggtgttgcctgaaatttgcagtttacagaaatatcatttactgaatttgtgcttatattttctactagaatatccgccaatttttttgtaacttaccaagctgaaaaacgaaaaagccttaatgtgaatttccagtacagatttagaattagctaaatgtttttaaataattgaatatacattatatacatactataaaaagcgttgatatatcatatcaattggattgtgcaatttacaatgaaaacttctaaaggttatgcatgttacatttgacagttgtttatctgtgatcccctaagttatcctattaattcgtatattttattactttttgggtttaacgtctgtgtagtttcaaaacggttttttattttcaaatttactttagtcttattaattattggaattaattataaaggaacttttcttgtgtatgtgtcacaaatattacttttcaatttttcaataaaggtaagtctggttaaaacg

SEQ ID NO: 77 - DNA, 1461 bp, Rhynchophorus ferrugineus
gtttttcttctcgaccatcggccgcggaaaacgctccttttcttctcttccgagcagttgcagttctcgcaaacgcaaatcatgacaggccaatcgcgtacgcccaagtgaaagtgcccgtctcattcggtttcgtgaactcgatcgatttccgaacatcgaaatgcggaagaacagtatcgcggtgttggcgttgttcgtgggctgctggagtttggggaacgcggctctcgagttcgacatccgggtgccgagggtggccgattttttgaatagggtctcaaacaccacgttcggtattatacggggtggcgtcaacttggtgggcctggccgccgacagggtaataaacacgttcggacgcgtcgaagacagattgagggctctactcgaagaattccgaggtgtcatcctgagaggcatcccggaactgaacattcccgtcctggatccccttcacgtgaaccgaattaatttcgacgtcaatcaggacgccgccaagttgaaagggaaagcggagaatttaaccattaagcatatatcgaagtttcaggtggacaaggagagattcactgacttgggtaattttagattcaaacttgaccttaatctaacttttccttacatcaaagtaaccggaaactacaaagttgatggtaaagttggcaagaacttcattatttacggagatggcccgttttggttaaatttaatcggattaaagttgggtacctcaacaatattaaagttcacattaccagcaaaacttagagttgaaagtctgagcattgacattaagctggccaaattagagaattacttcagtaacctgttaaatgacaaagaggtaggtgatttggtgaacaaggcgatatctcggatggcaccggaagctttggacatcttgtggcctggaataaagccatcctattcaacgttatcgtttaaaagtacatttgaagcttttatatacagggtgtgagaaggaaatatcgtatcttagtattaggtttgttattattaaactctgttctttttgttacctgtaaatatatgcaagaggtgttgtatataatttggtagaagtactttcctttataaatgtgtgtcatggataatgttggtaataatatgaaaaaggaatggtgatattcaccagcaatagtacactaatatataccagacgtgaatttttaattaggactctgatttttatgtctcatattatgggatgggtttaaaacgacgatttgaccccaatttattcggcgtcgattttttttaacggactaaaattattgttgattaggtttagcttatttatgttatttatggcatactgttttaaaaggttctctatgaaaattgatgtttttttatccaatgtaattttgtaggttgttaatgttaattacacttatagcatgtatttttttatattaaatgttccaggaaaaaaaa

SEQ ID NO: 78 - DNA, 680 bp, Rhynchophorus ferrugineus
gtgttttgtagacgagttcattttgtgggttgttttataaaaaggtagtggtttttttggaaaaatggccagtcaaacgcagggaattcagcaactattagccgcagaaaaaagagcagctgaaaaggtctctgaagctcgcaaacgcaaagcaaggaggctgaagcaagctaaagaagaagctcaagatgaaattgagaaatatcgtaaagaacgtgaacgtcaattccgtgaatttgaagccaaacatatgggttcaaaagaggatgttgctttaaaaatcgacaatgacaccaagttgagaatttccgaaatgaatagattagtacaagggcaaaaggagggtgtaattcaagaaattttggcattggtttatgatattaaaccccaaattcataagaactaccgtcaataaacaagcagtatttgttaaagattgcatttaagcactaaaagtgttttgtagatacttaatgtattaatttagttcattccattgtttaatactaggtgtatatttcttgtagtaactacaagaagttctattttgaaaatgtaaatgtgcaagaagttttttttttggtgcgaaagctacttatatgtaattatatctttattgtctgttatatttatcacttttgtgaagctaaataaaatgacttaatcattaaaaaaaaaaa

SEQ ID NO: 79 - DNA, 218 bp, Rhynchophorus ferrugineus
acgtccggtaaaatgaagatgatgtttgatactttggtgtctaaaaccgacggtttggagaaactaatcgatggttacatcacccgcaaagaaccggttgatataaaggaagctgcagctcggtttaccacggatatcatagccagttgcgcgttcggtattgagactgatgccatggagaacgaccggaatgatttccgaacatatggaagaaaagt

SEQ ID NO: 80 - DNA, 1913 bp, Rhynchophorus ferrugineus
ttttaaataatcgggcctcttatctctgatgaatgcaagtataaatatgtaaacaaagaggcatgcagttattactaaaattatgtcttatcggaatgagtgttaaattttcatacactgataacatttaaaatattatttctctattagtgtcagtttaatcaatgtttgttgtcctggaatcaaaatattttgtaacaaaagtgatgtttgaatttttgaattgcgtctaatagtgttatcttaaatttataattgtattatttataatttttcattgattctcattattatagtaatagcaatgatatatatatcttttgttttcctttgtgcagtacaattgagtttttgctcagatatatatttctatcaaccagaacaaattcatatagcttttggtgaaaacctacaacaaattgtcataacttggtctacattgaatgatacaactgagtctgttgttgaatatggtattaatggtctcatattaaaagcatcaggatcatcaactgaatttgttgatgatggtactgaaaggcacactcaatatattcatagagtgctcctagataatctatcctcaaatagcagatatgaataccattgtggaagtgataaaggctggtcaaacatttttttcttcaaaacgcccccagaagtaaataattggatacctcatttagctatatatggagatatgggaaatgagaatgcacaatctcttgcaaggttacaagaagatacacaaagaggtctatatgatgctattctgcacataggggattttgcatatgatatgaactcagataatggtggtgttggagatgaatttatgaaacaaattgaatcaattgctgcctatgtaccctatatgacgtgtgcaggaaaccatgaagaagccaacaactttagtcactatcggaatagatttagtatgccaggaggtacagattcactttattacagcctcgatattggtccaatgcatattattttcatatccacagaagtgtattattttatgaactatggcattaagagcttagtttttcagtatgaatggctggaaacggatttaaaaaaagctactttgccagcaaacagggaaaaacatccctggataattgttgtagggcataggcctatgtattgtagcaataataatactgatgattgtactcattatgaaacattgaccaggacaggattgcctttcttaagttggtttggccttgaagatttgttctatgaatatggtgttgatcttcaaatatgggcacatgaacatagttatgagagcagttcattttaccactggatcagctggatgtaaagagggaagggaagaatttaaggggaaacggccagaatggtctgcctttataagccaagattatggttacactagattgaaagcttttaacagtactcacttatactgggaacagatatctgatgataagcaaggagccataatcgatagtatttggtatatcaaggacactcatggaccatataactgagcactagtagtacctttacagatattttaaataatattaaaactaaatgaaataccaaattattatcataatttttattcatcccgatgtttagacaatatcacaatattaataatttaaaacacattattaagtacaccaataatgccatattaatatgtaaattgatttagtaatttaaatgacaatacactttgtagttttagtctattttaatttgaagcttcttatttgtcctatacctctacctaaattaaactttctctcagcaacacatgtttcattaatcagtttaaccctcttcatacaatttcctaataagatacacttatagacttttgtgttaaaagtatagaacatattattatcacctccattaggacctac

SEQ ID NO: 81 - DNA, 306 bp, Rhynchophorus ferrugineus
atgcagaacctcaagatctttcaaatctacaatatacagagagggtaataaaggaaacattgaggttatttcctgtgggagcattttttgttagatcagtaacggaagatacggatgttggtgacttcgtaataccaaaattctccactgtttattttggtgtagtttatatacacagaaatgctaaatactggcctaatccattgaactttgacccagaccgatttttacccgaagaagtagcaaaaagacatccgtgctgctatatcccattttcctatgggcctagaaattgtataggaaaga

SEQ ID NO: 82 - DNA, 1542 bp, Rhynchophorus ferrugineus
cagtgggtgcttgataaataatgatgacctcgatatatataattatatcgatactagtgttgattctgtgctatttaagatggaaatttacttattggcagaggcgcggggtaaaacaggtgaccgaacaattcatttttagtaaaaaatcattaggagagtctattttaatccgatacaagcagggcaaagcaatgaaagtgaaatatctaggggcttacttgtttcacgtgcccagcttgctacccatcgatcccggcttgatcaaggatatcatgataagagattttgcgtatttccaagggcacggtacgtaccacgaacccagagatatcctcacgatgaacttgttcagtttggagggtgaaaattggaggcatttacgagccaaacttacccctacgttcacctccggtaaaatgaagatgatgttcgagacattggtggagaaaacagggggtttggagaaagtggtcggtatgtacgctgattcgggaaagagttgcgccattaaagatatcttgggtaggtttacgacagacatcattggaagctgcgccttcggcatcgaatgcaactcgctggaagatccggagacggagttccgagtgtttgggaaaaaggtgtttagatttaacgcactgaatttcgtcaatatactggtgttccccgcttggtttctcggcagtatagggtttaaatttaatgggcatgatgtcacagattttttcacgaaagtggtgtgcgataccatcagccacagggagaagaacgaagtggccagaaacgattttatgcatttactgcttgaactgaaaaacaaagatcggtctgtgaccgtaaatgaaattattgcgcaatgttttgtattcttcctcgctggattcgagacctcctcaacggccatgacgtttgccttgttttgcctcagccaaaatcaaactgtccaacagaaacttagagatgagattaatgaagttttgcagaagcacgacggaaacatcagctacgaagctgtcaaggagatgaagtacttggatatggttgttaacgagacattaaggatatatccgccgcttccgggaattcccagagtttgcagcaaggattaccggatccccggaacggatttggtgatcgaaaagggcacgcgccttcaaatccccgtctggggcctgcacatggatcctgactattatcccaatccggaagtattcaatcccgagaattttaacgaggaaaacaaagccaaacgccacgagtttacctttttacctttcggcgaaggtcccaggatgtgcataggtctgcgtttcgggctgatgcaaacaaaagtgggattgattagtctcattaaaaatttccgttttaccctcaacgaaaagaccaaaactcccgtggagatggaaagaggtagtatcgtgctgtcggtgaaaggtgacgtatggctggacgttcaacggatttgagacaatgctcattattctttgttattataaaattcatatattaataaacgtaacacgaaacaaaaaaaaaaaa

SEQ ID NO: 83 - DNA, 2544 bp, Rhynchophorus ferrugineus
actagcgacccgccccggcttcgcacgggtgcaatgctgatactaaattaaatacactacagaaaaaatatgaacgttgtatataaaaacatagcggcccgctccgactttgcacgggcataaaatatatatgcctatgtcactcaatgaaaacatgattaaaatcgatccagtatttttggttcattcattactgcccttggcctgcacgcattaaatttggagtaaaacaattcctcttcccctatacttactatgaagatttcctgctatctttggaatatctaaattcatacaatttttattacattacacatttttaaacgcaaattttaaatttgtaatatctccgaaaatatttgtttaatttacatgctgtaaggaaccatattgatctatattaattgcacactgtatttaaggtacttaattcgataaggattaatgccgtattgcttaaaatagcttcgtaaataagccattttctcacgtaaaaagtaaacaataaaaatggttaatgtgggttatccctaaaagataaacatataccatcgcggacttttttgtagacctttttatggtgtacaatactgtagtacattaatttgatctaactcgtagggttaggcagcgtttttgctaattgctaaataagcctaaaaaaataggttaatttacgacatcacgttagaaacctctaaaattagcaatgttgccttagtatattatgcatgtattatacatataaaccttcctcttgaatcactctatctattgaaaaaaaccgcatcaaaatccgttgcgtagttttaaagatttaagcgcacatagggatatagggacagaaaaggcgactttgttttatactatgtagtgatgtatttttatcgttgattgcctatgttgatattctaaaatgagtaaaaagactagaattatagaaaataaaaattattttggatcagtatattctcataaaattcgtattttacaaaacaatatattaatattataataattgtatcaattatgactaattattattttcatgtccctcttattttcaccaatttagtgaatactccggtgtatatattaaggatatttaaatatttttacaccaaagagccctaaggataatgataccgatagtctaccagtactcatatactattatggaggtgctttccttggaggtggaccaattcgaaaatattatagtccagattatcttattgataacgacataatcgtaattcttcctcattttagaacagcggtttttggatatctaagtactgaagatttaaattgtcctggcaactggggtctaaaagatcaaatcgctgttcttaaatgggccaaccaaaatgttaaattcttcggtggtaatcctaatcaagttaccatcgccggacaaagcgccggggcagtcagcgtgaattcaatactattatcgccaaaagcgaaagggttgttccaaagagctataatcatgagcgggggtagcctgtgtttctggggatatcaaactaactccaaaaaaatagcatttgatatcggcgtagcactgggaatagaaaccaatgacactaaacatttagtgaaggagttacgacgtgttaaatcagaagatctgatgcatgctcaaatcctagtgatgctagttaacttcgccgaaactttaacgaatggtctaccgtacacacctaccattgagccataccatgaaggagcagtactcacggaattcccttttaatcaactgaagagaggtaactttaacagagtaccaatattaacaggtgttacttcaatggaaatgattttgtttcaaaaagttgcggatctcgtacgcccgattctttcagtcttcgatctgagtcccggtctgttcgtccgcctaacgaagaacagccaaaaccgatcaatcgtaggcaagaagatcaaggaactctttttcgataatgccaattttgcctctttatcggacctcgaactgatgacattcttatcagacgacgtatactggaggccggcccgcaaaatggcagaactcgtatccagatatagtcccgtatatttttataaatttatgtacgaaggagaattgggtttgaccactaatacacggttcaacggcctaaccaccagagcttatacaggagtgggacatacagaagatacctactacctgtttgaaaggccagaatacaagagaaaccaggatgacacctacatgtccaagaaattatcgaaaatctttactaattttgttaaaaatggaaacccaacgccagtaaaagacccactgctcgacaatataacctggccaagagtaaccaagcaacagttcccttatgtggaaatcaataggcgtttaaaagttgtgtcggaaaacttcaatgaaaaaaggtatcgaatatgggaatatctctaccaaacctacggagacaaaccgtacaaagtgtattaaatatattcgcctagacattactaattacatttttttaaattgaaaaaaaaaaaattaccttaaccaac

SEQ ID NO: 84 - DNA, 954 bp, Rhynchophorus ferrugineus
cagaaagataaatggcaattatgtgttatactggtggaataaaaacatcaccagctgactgtttattctatgaaaataatcgacacattaaccgtgttccgtgctgtagcggctatttttactggttatatagttaagtactcttgctaagaagatgttttggcttgtgttagcggctatacttgccatcttgatttggtacactctcgataagcctttgagatattggtcggacaggggcgttaaacaatcgaagccatggttgatctttggagacagctgggtgaatgtattccgaacaaaaagtttttgcgagtacatagaatgggtgtataatatgcaacctaacagcagatattccggtatctaccaatttttcacccccactttgatattacgcgatccggatttgatcaaacaaattaccgttaaagattttgaccatttcacttattcccttaaaaggacaacgatggagagagatgagagcaacattgactggaacttttactagtagcaagatgaaggcaatgtttagtttaatggacgaagcagccgatacttttgttaagttttatggggataaaggcggcgataaaattgaactggagatgaaagaaacgtataccagatatactagtgatgttattgctaccacagcatttggtattaaggtggattccctaacgcaaccagagaacacgttctacctgatgggtaggaagataacaaacttttcaggaattttaatcagcctaaagttttttggattctttctggcaccatcgcttttcaagaaattcaaaatatctatgctggataaagctgcgtccaagttcttccgcgctaccattaatgaaactatccaaatgagagaagataaaggtattgtacgccctgatatgataaacatgttattggaggcaaggaaaggtatcaagcaagaagataata

SEQ ID NO: 85 - DNA, 1131 bp, Rhynchophorus ferrugineus
tgctgtcaggaactcagtccaattgttaccataaatgatggtaaagttcaagggattcttaacaggactgttcgagatggtagagtttattacgcgtaccgtggcataccatttgctaagaaaccagttggagacttaagatttgctcctccagtaccaaatgaaccgtggtctggtgtattaaatactactactgatagagatagctgtacccaagtgttgactgcagaggatccgacccttcttactggttctgaagattgcctttatattaacgtatataccacaaatttaactggaagactccctgttatggtatggatatacggaggtagtttcgtctttggatcgtctgaatataaaatatatcctccagattatttaatagaaaaagacgtaatcttcgtttctttcaattatagattaggagtttttggatttttgagtactgaagatttagcagcgccgggtaattggggtataaaggatcaaattctagctttgaaatgggtaaaaaacaacatagcacattttggcggtgatccaaataaagtaacgatatttggtgaaagtgctggagcagcttcagtttcatacatagtgaataatccttcaacaaaagacttatacggcggtgcaattatgcaaagtggtactagtttatgcgtattcgcgttaactagaaatgccagacaaaaaactgaactggtggcgaaagaactcaatattaccgagaccaattcaacgaatttaataaaacgtcttcgtctggtagattataagaaattgaaagctgctgaagttaatgtaactataaaggtctttgtaagtgaattattaggtggtgaaacatttggagtggtcgaggaaccctatcatccaggcgcagtccataccggtagaacgtatgaaatcttgaaaaagggaaggttcaacagagtcccgtcaattatcgggttcaattccaatgaacttggtgcgacactgacatcagataactatgacgtagttactggtattttaaatttaacagcaactccagcggtatttgctccgtacgatctgacaggaaatgtttccaaattgaacgaagcggggaaacttgtcatttctcactacttggggccatca

SEQ ID NO: 86 - DNA, 4978 bp, Rhynchophorus ferrugineus
ctaagcgccgatcttatataaataggatagcgctgaaattatatgataataagtagccacggcatattagtttttacaaatatatggaacgaacaacatgaagtggattgttcttataactgttccttctctggtctgtgctttgataccttcagtaactctaccacatggagtagtagaaggtggtataggaacaacagtaaattccaactcattctataaatttgagggcataccatatgccaagcctcctgtaaataatctgagatttgagcctccacaagacccagaaccatggctaggtatctggaaagcgaatattacaacagcctgtatccagtacgaccatctaactagagataccgaacaaaattatgtaattcatggcgatgaagactgtctctacgtaaatgtttatacgaaatcgttagatcagaacgccaatttggacgtattatttcatatacatggtggggcgttgatgtttggcagtggggcaatttatgggccagaaattatcatggagaaaaatctggtgtatgttaacttcaactacagacttggtccattaggttttttaagtacggaagatgaggtattaccaggtaacatgggcttgcgggaccaaataaaggcattacattggacgaagcgatttatcaaatattttggcggaaatcctgaatctattactgtacaaggcttttcagcaggcgctggtagctcccacttgcactattttcttcctgaatctgctggtttgtttaaggctggtatctcacacagtggatctagcttaaattcctggatgttggtagagcaagctaaacaaaaaacgcaacaactcgcgaatttcgtaggttgccctgcagataattctgcagaaatcgttgcttgccttaaaacaaaaccagccagacaaatagtacagaccacccgtatattccaggaattcctttataatcctttttcacctttcggcgttgttatcgatggatattggtcaaaaaatccagttttacctgatcatccttataaattacttcaacaaggcaaagtctacgacgtgccctggttaatatcctacaccacgtctgaaggactgtatcccaccgctgacttctacgggaacgatgaatatttataccaaattgacactgaatggaataaaattgctccgcttattttggattataacaataccgtttatccagaatggaaagacgtggttaatgatagaatcaaggatcattatttcggcgagaaccaagtgactatgaacacttttagtatttttgtaaagttggtgactgacaggctgttcttaactgatattgaaaaggctgccaggttacatgcatcagtgacaaaatctccagtttacatgtataactttaactacaacggcagcacaagcttttccaatatactaacaggaattgataaacatctcggcgtcagtcatggagatgatgttattttagtatttaaacttaacggcctcgattccttacaaacagaaaaagacaaagagatctctgaagtactccttaatgctataacatccataatgaaaaatagaaaacccatagttcctggtatttcctggacaccactaccaaagaccacaaaaggatcatttgaaatgctccaaatcactaatactggggatctaaaattgctgaccagaaagttcattgggcagagcaaattttggaacaagttaccgttacaagaaaacgagaaactttttatcaaaaaggaacataacatagagtcgtgtagtgaagattattgatactcaaaatgaaatgtattttattgtatatgtaaggccaaaaatcaaaacagcaaatattgaagtataatctgtttttattaaaaaatatgtttcaaacaaactgattcgccataataaagatttcatcatcattatgtccctatcaatttaagacatattaaataaatataaaataaagctaggtatttgtttttacttgtacattttaaatgattctgtgtaagctacctgtaaatctaggacgactttcatttgaatccaatgcgaaaagtaacagcaaactgcatcgctaaaggaagcaatatttggaaaaagaagcttaaacagaactcgcaggtataagtgggagacaccgctataccgttaccccgacctcgcccaaaatgtcagaaaggcgttccaggtgtacggtcactgaacaagaatccttattcttctgacttctgtttagcaactgaagagcattcatgtattctagctcactaaattctggtcctttatccacgattccgtttaagatctcctcaggtgttaaaaagaataattcaaaatagtgacgagcatgatccaaagccagttcccttgtcatggttatattggtcagggtctgctgcaaggcaaaaatattcctacacatcctctgtatgccggcatcatcgataacctgcatgtactgcgcagaactaattaaaatcttagcaattaaatgacccaggccttcaaaaatatatttgcatttcctaggatgcaagctagacgtcatggcttcatctacattagctaagacacgactaagctccaacactttaggatccggttcatgagtttccttattatgatgagtttgagctaacaaatagtggaaacactggactctgacctccagatgaagcaataaaaggcaagtgtttgctagttcatcatattcttgtgctatactggtaagctgttgaagagtggcacttgatactggaggcattaactcactgtgagtattattgttgtcagatttagggggagataattttaaaggttctaacctaaactcactggtgtattgaaacatacgaactgagaaccattccatactttcttgtaaagttgctaaatccttcaacaaggtcatatcagataatatttctcctgcagatacacctccttctccaaacccttctccctctttctgttcttgcatggaactcttgctgtgctttcaaatttaaccaattaggaagagattttaaaaatctgttaatatcgtcgtctttcaaccaagcggcactacaaatccttttatcttcagagtaaggttgaacaatgcctctgtacgcagcataacacgtgtctttgtactctttcagtgccatcacagaatagtcagctattttctcgctataaagcggtaaagcttgtaatacggccttccactcacgaatacacctttcaacagttacagtactgattaataagggtttataatcggcggttaaatcaagtaaaacggtgcccttccatgcatctgctgccttgtacgcactttcaatttgttccaaaatttcatcagactttcgcttcaaatacacatttgatatatgttgggtaatgcatctgtataatgaacaagtcccatgagacatacccaatgtttgttctatatcttctgtaaaacacatgaatggaataaaaactactaaaatgttattaggatgaggactacaaatcagaactttgtctttctttgatgactttaaggcattgcttaaggtaagagcacttgaggagccttcaaatttaaataaaatcttctttttactctgctgttttcttcgtgaaaaatatgctgatatatcaccattatctacagcattgttaatttgtaagtctgtagacatattttgtagatccaaatagtcatttaagaatatctgtaaaacttcctgtacttgagaccaataatactgcatactataaggcttcaggtcaattttatgtgaatgtatacctttatcaacccattttagaaatatttgatgagaatctgcaatttccttaaattgatcaaacaatatatttactaattcttttagtgctgttttggattccacattttcagcataatcaataacatgttgagttgatttttgaattatatgtgtaagagatacttgcatttctttaaccaattcatctatagcataaggcagcttccctaataaacaaagactcttcacgagtattgccacatagtgtctatggttttcttcaatatttatgttatccaaatcttcatctagattaaaattttcagtgaataaatctttattaccaacttttgaaatatcttccaggatattccttgaaacattactacggtttctaccgctcaatcttgttttagtacttctctgcagtggtgaatgtattaagaatccatcacgcccagaaccctgccttctcaaagttagaatatgctgagaaggttttgtataaagaatatgttttaattccagtactatttgtaaatgtaattgctcctttttttcttctagttcttgactaagctcttttaaactctcaacaccctccaaaggatcttttcctagattcacagcctctactaacaactttgttgcatgtaaatattttttatgtgccatataatttgaaaattttgttggtacttcattcattttttcaatttcatctaataattgcaacatgtatttatactctaaaccctccatccataaactttttaattcatctcttttgcacctaagtttcttcttacaatcttgaagcttctctttcacttggtgtattttatcacgattttcagtaacagattgtgatatcgttccaaataggcgcataacctgtgtaagatctttttcatgtcttgatactaattcatctaatttacggtcacagactttataatctgcctctaattttgctttctctctatccctctgttcattagtttcactggcagatagagtacgaattactgacattaacaagccactagtctcctttaaaggcttaacaccccttgggggttttacaggaggggactgatccataatcccttagaaaattaaagaaaaaattaactaaaaacgaaaaacaacacccacatttcgcactgctttggtcatcttgacagacgtcacc

SEQ ID NO: 87 - DNA, 222 bp, Rhynchophorus ferrugineus
aacgctctggatgacgatacgtccgtttatgtcaaaaacttgaaagatctatgcgctatattagcaagaaaaatattttcacctcttgattctaaattatatccccttacctggatgcaccacaaggaaaaaaagcatttaaaagtaattcatcgatatatcgaagatgtgatacgacaaagaatcgaaacaaagaagcaagaaagtttaaattatcacgaa

SEQ ID NO: 88 - DNA, 845 bp, Rhynchophorus ferrugineus
gggcttcacaaaatcacttgcgtaatagtgagccagtgtataactcaataatgttatcaatacgtatagttggtcttggattattcttgagcgttgttagtggaaaaaatgttaaaatacccaagggtttaccgacttgctataggaatgatccaaacctcaaccaatgtatggtagaagcgaccgataagatccgaccaatgctcagggccggtattcctgaattaaaaatcccgtcgctggaacccttcaacttacctcaagtggatctgcaacagggatcccaagctttgaacttcaaagcgacactgaacgacgtcgttatccacggactgaccaactacaagttctctcggtttgatttcgatgtcaagaatttgcagttcttttgtgaagcccatcttgatagcatccagcttaacggtaattacaatgtcactggaagaatcctcatagctcctattgttggaaatggcaaattcgtagctaaaattgactctgctgatgctgtagtttaccagaaatatgaaataggcgacataaaaggtaacaaacacattattcccgtcttcaccaacagttccataaacgttagcggaccaaaagccgtcttggatggattattcgatggtaacaaagaactaaacgacattaccaacaaggccatcagtgacaatgtcgatgagctcttcgaagacttgaagccagtggtcgaagaaaccatcacgagaatcatggaagatcttttgttgaaacatttaaccgcaaatatcccttatgatcaattatatcctgttaaaccataaaaaaaaattatgtcgtttcttaccaaccgtccttggccc

SEQ ID NO: 89 - DNA, 1481 bp, Rhynchophorus ferrugineus
caacatataaatgcggatgacatggaaattttttttagtttcacggaaacgttttacgaaaaacagcagcaataaattaaaattacctactaattcgcgatgtttaaagccgtgtcgtttttgttgttcttacgcatcacgaaccctgttataggggccataccttcgtatttgaaaatgtgtcacactgggcctgatttggtgaaatgtgccatagccaatggaaacgccgcattgcccgaactgctaaaaggcaatgaggtgctaaaggaaacctcagaatgaaatttaacaatctggaggttcatggtctggacacggttacactaactgattttagagttgactttgacaaacgtacgatatatatcacaattcatgcggacaaactagaaattagatcgcaatacgatgtcgatggcaaagtattgatattgccgataaaaggaaatggcaaatgcgttgttgaattagaaaatggagatttggaatacacttttaaatacagattagaggataagaatggtgttgaatatagtatggtagaaccagatgacgtaatggaatttaaaatagagaaagcacactataattttgagaacctttttaatggaaataaacaattaggtgacaatgtcaacaagttcatgaatgaacacccacaagaattccttagcgaatttagcggaactataaaggctacgctgacatcaatagcacgtgacataacacgtggtgtattccaaaatataccgttcaaagatttgttcattatgtagacgaaaatatttagaatatattcaataattttgattagtcttaatttcattttcttgtttaaaaatgtaaattgtttgtttgtattaaaataatgaaatatgatttttaaaaaaaatgtttttgttgtatatattttaaagaaatttgttattatgactttgtttttttagaatttaaggtaaatattacttgtcaattagcaaaatcataatactactttactctagtacagaaaaggtttttaaaagtaaataacgatacctcttaagatcccctagatgatgtttcctttatcctgtgcattttacgccggtcagatgactgtgagcccaattgtggaatattattgcttaactaaggtgcaattcctaattgtaaatttattattaaatttttcataaaaatgtacattgataattggattaaccttaacctattgaaaaagaatatattaggaaattagaaaatataaattagattgaaatagattacaaaatgacaacgttaatatcattaatccggaccatataccaaatgaaaaaggaccaggaccaaaaataccgtatatcacttaggaagatgcaatctactacccatttactaaaactaattaattgagttgcagttgttatggctggcaacctatcaagatatgagtatacaatgctgagataacacgttgcagatgatcgatcgacaat

SEQ ID NO: 90 - DNA, 1966 bp, Rhynchophorus ferrugineus
agtcatcaatcattattacaaaatactgatttatgatgtcattagtgataactttaaggactatatatgaacctaacctaactttttatttcgtcggcttatattcagtaatctgtatttcatgttcgcttaaaacaaattataaaaatgagttcctatgaagaagaagctgtagatgttaaggaacgcaatgaagaggatatagtaacaatattggttgctactgacattcacttgggttatggagaaagaaatgctaaaatagctgaagattctttcgttacatttgaggaagtgttgaaaattgctaaaagagaagctgtagatattcttttgttgggtggagatttatttcatgacgcaagaccttccagctatgctttgaataaatgcattgaactgctcaaaagatactgtttaggagataggccaatcgaaatagaatttctatcagatggtgcctttaatttttccagtaccattaatgatactgtcaattatgaagatccaaatataaacattgaattaccagtattttctatacatggaaatcatgatgaccccactggagttcatcaaatatctgctctaaatatattatcatcaacgggattagtaaattattttggaatatataatagatatgatgacatagatattgaacccattcttctgagaaaaggtcaaactaaaattgctttgtatggtttgtcacatataaaggatgaaaggctgggtagattgtttttagataagaaagtaaactttttaacacctccagaagttgatgagtggtttcaactgtttgttctccatcaaaatagagccaatcgtggagctaaaaattttatccccgatgatgcattgcctgaattgttggatttggttatatggggacatgaacatgattgcaggatagatccagaaacaaactcaaataaagtgcatatctgtcaaccgggtagtaccgtagcaacatcactatctgttggggagtctttgcaaaaacatgtaggcctattcaaaatccataaaaaagagtttaaattggaagcaatacctttaaaaactgttagaccatttatctttgatgagtttgtatttggaaatgaacaagatgatgaaatgctcatgtcaaaagataagagtgatcatcaggaaatggcgaaaagagtggttggaaaaaaaattgatgaaatgattgaacgagcaaaagctctaaatagagaaggaaataaactacctttgattcgtttaaatgtcagttacaataaagagtcccaagcatttaatccaattcgctttggtgaaagttatgtagacaaagtagctaatcccagtgacatgattaaaataaaatgcatgaccaaaaaagagataactagaaaggataaagcacaagcaattattactgaagaccaggcatcacgtgtggaagaattagtagccgattactttgagcgtaacacatctgagaagttaaaattctttccagtaaataaattaaatgaagcagtctccaaagctgtagattcaaataacatggatattttagatgatgtgataaaatatgttacagaaacaagattaaagaagctcaaggagaattcaattgaaattgaaaatattcaatcttattgtgcaggattattagaggatgaagatgctaatatgtttgatgagatattaagtcgaacgaacagacaagctagtacaagcgatacaactgcccctgctgatgtcgatgcagatgaaacggacgagtctccacctattgaaagcccgaaaaaggccacaaaagctaggggcgggcgcggatctagaggtggtaggggtgccggtagaggaagaggaagagccaaaacaacagtatgaatcaaattataatatgaattgccatttattttttaaaatatattataagtttagcttttaataatgttttgttttgtattggaaataaata

SEQ ID NO: 91 - DNA, 3490 bp, Rhynchophorus ferrugineus
atttatcgtaaaaataggaaattacacatttaagaagcttatattttttgatgataataattctaaattattaaaatgttgaaaaagaaaactagctgtgttttcatgattatcaagagaggtttaaaacaattttcaagaattcctggaccaaaatcattacctgtaattggtacattgtataaatatctacctgttataggggagtataaatttaataggctgcagtacaatggatttaacaattacaaaaagtacggtcctgttgttagggaagaaattgtgcccaatgttaatatcgtttggctttttgatcctaacgatattgaagtaatgtttagatgcgagggaaagtacccccaaagaaggagtcatttagcgttgcaaaagttcagattggatcggccgcatgtttacaattccggtggattattgccgacaaatggacccgattggtataaaattagaaaaatatttcagaaaggactgagtggacctttagcagttaaaaagtttttgacaggatctgatgacatagtcaaggaatggatggagataattgcactaaataaaattaatccagagagcaattttttaccagatctatctaggctttttttagaattaactggctattctactttggatgtcagattgaacagttttatgccaaaagaattgcataaaaactcgcgatcttctaaactaattgaagcatctttaataacaaattcgtgtattttgaagttggataatggcttacagctatggaaatatattgatacgccgttatataagaagctgaagagatcacagttgtacatggaggaagtagctattgatctgctttccttaaaaatgtcaatatttgctgaggaagacattaataaagaggtaacgctgttacagcagtatttatcatgtcctgatttagaattcaaagatattattggaatgatttgtgactttttgctagctggaattgacacaactgcgtataccacttgtttcttattttatcatttggctaaagcaccatcagtgcagatatccctgtttgatgaagctaaacgccttttacctgaaaaaacaagcccggtgactgaagaagtactgaattcagcacgctacgcgagagcagtgttaaaggaactctttagactcagaccaatatcggtaggaattggcagagtgctcaatgaggacgccgtgttttctggttttgaggtcccgaaagatacaattacggttagccaaaatcaagtgtcctgtaagttggacgactatttccccagggcacacgagtttaaaccagaacggtggttgaaggatcatccattatacgagaagaagcatccgtttttactattgccattcggtcacggtcccagatcttgtatcgctagacatctggccgaacaaaacatactaatattgttacttaacattataagaaactacagcattgagtggaagggttcgttattggactccaagtctttgctgatcaaccaacctgatggaccagtcttgttacagttccatcccagataaattcaaacgacgccaccgtgagaatcggtacactttatttttatacgatatttttaatcaatgaaataattttgataatcatctttaaaaataaattttattctggaaactaactagggagtttcttaaactgttatatatccaaagggtaaataaatacaatcaaaaaataatccttgtgggcttacacctatatacaacgagtcagaaatgggacatttgaaatatatgtttaatattgtttggttgagatctattttgtccgcgcaattcatataatcaatccttaaatatctagacacccatgatgactctcttagttcttttttcttgttggatcatggtccttcgagcactgacacagaacttggcgcatagatctgagattaacaggaatccaccgagtctttgatgcgaaatgatgctaaacgtctaattgtgtatccacgaaagccgaacggtgctctcaccgtctgcaagtgggtagattaactctgaagaacgcgttcagttctatcaaactcgccagaattagaaacaccgcgtacatcaacaaacagatcaggccgactcttttgtccaggcggaacttgttgagcgcgaacgcaccgtagagcagcagcagggatgatagcaggctgatggcactgtattctatcccagcagaattgatgccgacccaatgtttccccggaatagttggcataaaagtggctttaataaaccagggtaaaccaagacacaaaagaatatcgaatgtgttggatccaatggaattactgatgcccatagacccgtgaccttgtctggttactataacactggaaacggcttctggtacactagtacccgcagctaggaaagttattcccataacggaatctggtattcttaacgtatcaccaattatagtaatcatccaggcgactatgtaagataacgatccgatccatataatgcacatcaggaaggttacggggaaccattttttcaatttgggtttttcgcagtcgggtatggtcagaaagaaaatcaaacgaatcggccaagtcacgatccaagtaaactgtctgaaagtccctttattcgatggccatttccaaaaaggtagttcctgttcggtatctcgactgctcagctctaattttaattcgctcttgacgtctagctgctcggggctgttattctttacggatccgttcaagtgtgtctgtttattgtttgtttccgtttccatagtaatgttattgtcgtttgtttcaatagattttccatgggagtcgttttcggaacagttatttattgttgaatgatctggtgatattgagcattttcttggtttctctgtcttcggtctaatttgtttaataccacttcttgcccatttctgtatcgatttatcgaaatacattattaatatgtagataatgtacagaagcactaatataagagcctcataccactcgattctttcatcgtgtatgatacatattagaatagacacggttattccataggcgagacaatctctcgtaagaggccaccagtccagaggtattactttgacgccacacatgccagcgcagacaccacaacatgctgccactgctagaatattaaacacggcggaacccacaatagtacctactccaatatcaccctccgtgatgaacgtcccaataacgttaacaaaaagttctggagctgatgttgccgccgccataaatgttgctcccgcaacgtccaccgacatatttaatgcatgacatattttctctacggctggcacaaaataattatcacagactacagctaaggctacgaatagatacaatgacactaagatatgtataacaattgcaccatctcttctttcttcttctgataatagatcagatgggaagtcgtctattgcggggggagtgcaattaagtcc

SEQ ID NO: 92 - DNA, 2856 bp, Rhynchophorus ferrugineus
gtggggacatgcttacttatagaccgattacttgcatcaagttccagctgaaatgttctttaatgtattttgtgctctgatcgcgaccatagtggtatggtgggtgaatatctggaggaaacacagagacatagataaaaaacttcaatggataggaaaagtagcaggcattcccttattgggaaatacaatggaattcaaggatcctacaacaatgctattaaggatggagcaacgtcttctggagaataatggtttatgtcgtattcaaatactcagtaggactatggttctgatttccgattacaattttgtggaatggttgctgacgtcaacgaagattttggacaaaagtatcgattatcaattcttgtatcgatggcttgaaggtggaattctaattgccgatgctcccgaatggagaccaggcagaaaaattttaacaccggccttccatttttctatcctggaaaactttgtagccaaattcagcaagcctactacaattttgattgatatattaaagaaggagtccgacaaagattcagttaatatccacccgatcatagctaattttacgttagatattatatgtgaaacagccatgggggtcgaaataaacgctcaagaaaatcctcagtcgaagtacgtccgttcagtccacaccatgtgtaaaattgtcgttgaacgagcttttaatcctttgaagactaacgattttctttacaattttacattggataatattgccgaacgaaaagctgtcaaatatttacattcaacggctgatgcggtaatcaagatgaaaagagaagaacagcagaaggaagaagaagaagaaaatgatgacgttggcggaaagaaaagggtggcgtttttagatcttctcttgcgccatagagatgaaaatggccaaccattgtccgataagtgtatacggaaacaagttaatacaataatgtttgctggccatgacacaacggcttcagcattatgtttcactttgttctgtctatctaatcatctggacgaacaggagaaagcattgagggaaattaaagaagtttctcatgaagaagatacatttacttacaggaatttgcaagatatgaagtatttagacctgataataaaagaagccataaggttatatccgtccgtgccattttattcgagacgactgactaaagatgttgtttatgaaggttctaatgtgcttgccaaggatataacattgattatatgcgcacatgccattaacagaaacccgaatgtattcaaagaacctgagaagtttataccttcacgattcctggaaactaatattaaaccattttcctttttaccattcagcgcaggtcctagaaactgtataggtcaaaaatttgctatgcttgaaatgaaatatgtgctagcaaagatactcttgaactttgaggtgttaccagcgaacccgccacacaatccgatcatatccgctgagactgtattaatatcgaaaaacggcatcaaacttcgtttcaggaatagaaaataacgtagatttgattgttacctttgtcttaacagtactgattgtcttattttatttatgtttatttcagtatgagcattgtgccaaataatattaattattagttgtatatttgcaaaatttggctaatgaaacaaaaacatgaaagtgggcggtgataaaaactggaacaacctagtgtattttttaactttgtatttgtcatcgtaggattagataaaagccagtattttttctcttttctgcttttggtatataattgaagaattatttgtttataatatatagtgttaggatatagcaaaatatttgactgcatcagccaaacaaacttccttcctaatgccccttcttaacttatcctacgtggcattgaacttaatatatatgagttataaatgttatgatatattgttaatatagtgaaattgttacaatatgtttctgtaattatatttaataatactatatataacaatatataaatattacgaaattttatatcagtataatttgttttgttctgtcgttagacttgtaagcatataacatccactctaaagatatcagatgtaatcattaaggtggacttcaagttgacatttatagccaacgtaaaggtacaaactactctagttatcgccatatagcgtttaccagcatcaccaataatacgatagaataagattcgtataggtgctttgattagtaccatatattacttaaaatacgaggtatcaacgtagacaagtgttaaaaaacgaatttaacttataaattcgatgattgcgatatttctctacataaaatatttctttaatttgaaaaaatctactgccgaagcccatcaaatatttttagaaaattatggtgatgctgctccaacatatcccaattcttagtttttaacgacataagaatgttaatagcaccaaaaatttcgaaggtaatgaattctacgacttagacttatgggaggaacaggcagctaaaattttcaaagaatgtccagactgtttttcatttgttgaatcaactgtttctagatgtttctaatattcagttgatcagtgcaatatcacgtggcttggctggtacaaagtatcgaaatgctgaagaagtactaaaattgatcgatgattgtatagctgccaaactaacatccttctttcgaaaaaatatcaccatgttgccaggaagatggaaaaagttgtggaaaatgatattactatattttgattaacatatattgcgttaattatttcttagcaaagacctttttatagtaagaattttaaataagaatatatctatagctaaca

SEQ ID NO: 93 - DNA, 2011 bp, Rhynchophorus ferrugineus
catacctgtttattttgatttttttaaaggaaagctaccccaccttgtcaagtgaaattgtgcatttcattctgtgtcgagaagtacaggagatcgaaggtatttgcagcgattaaattcaaaatttcaaaatgagtccaaattcagctgccctaactacagaacattttgaaaagtttaagcaaactttcctctctgaagaaaaaaatttgcttgctcagaatgtttgttccaaggtagacccatttgaagttgcattatcaagaaaacgaattgaggagactcagcatatatttaacacaaagattgatgctgaaggcaaacctgtaaccaatcaaaagagctcaggtcgttgctggttatttgctgctttaaatgtaattcgtttaccagtaatcaaacattttaatttggaagattttgaattttcccaaggataccttttcttttgggataaaattgaaaggtgtaactatttcttaaataatgttgtggaaactgccaaaagaaatgaaccagttgatggcagattagtttcatttttactttatgacccaacttgtgatggaggtcaatgggacatgattgtcaatttgataaataaacatggtttaatgccaaagaaaaatttccctgaatcatatagttgtgaagccagtgcaagaatgaatcaggtcttgaaaagcaagttacgtgaatatgcaaaggctatcagagatcttattcagaaaggagctagtgatgcagatgtacaaagcttagtacaagaacaaatgacaaatatttatagaattgttgccatatgtttaggtattcctaatgacactttcacatggaactattatgataagagtaaggtctttcatagtgttggaccaatcactccaaaggaattttatgaaacgcacattaaaccattgttcaatgtagatgataaggtttgtcttgtaacagatccaagaacatccaatgaatatggaaaagcttacactgtggattgccttggtaatgttgtaggtggtaggcgttgtatttacaataaccagccagtcgaactacttttggagttaacagccaaaagtatcaaggaaggtgaggcagtatggtttggttgcgaagtgagtaagagatttgctggcaaattaggaatacaggacttgaaaatacacgacttcccactggtgtttggagtagatattcagagtactatgaccaaagccgaccgtcttctatatggagagagcgcaatgactcatgccatggtctttaccgctgttcacactgatgataaaagtgaagtacagaagcttcgagttgagaattcctggggtgatgacagaggagaaaaaggctatttgttaatgacttcagagtggtttaaggaattcacctttgaagttgtcattgacaagaaatttgtgtcagatgatgttttggaggtgtttaagcaagaaccgatagttctgccagcttgggatcctatgggtaccttagcgtgctaatttgtctgtttgctcaaaaaattacttttattttacaatgtgaacacgtcagtatttagacgcaatatatgtatcgacatatgatacatatatacatatatgtatatacgtttatatgtatgtatatatgtatattcaatttttaaaatgttttatgcacaaaattatcaatttattttaaatattataattcttgttattaattgtagcttgttatccgtagtaaaaccaaatgtgctgccactttattttatagttaccatttgatgaaaactgggtataatttattacttgtaaaatgtaatattgtgcacctgcttgccttagtaagtacctaagcctgtttaatgttttaaacagactacgatttaagtggtggtatatttacctgaatattttataaccatgattatttgatacacccaaatttataattatattcaatttaaatgattaatatagttctattatctaaaaatatattattttatactgcaaaaaaaaaaaaa

SEQ ID NO: 94 - DNA, 1431 bp, Rhynchophorus ferrugineus
aaaaatatacacgaagcgtcctaatataatacgtttaatacgtatgagataaaaccatctgttttcgagaacaatggcaactaaacaaatgttacgccatgggttcgtgtgtcaatgtcggagctatggttctactcagatattaagaaaagctgcctctcaaccaatagccattaatgacgtcaactcaaaagatgcttattacaaaaaaatgggccagaagctggatgttgatggaaggcctgagggatgggaccaagccaaaccattttcttctatacctggtccaaaacccttaccgatattggggaatgtgtggaggttctttccaggaattggcgaatatcataatattgaacttgtaaattggtataaaggtatgaaagaaaagtatggcgatatcgtttatttttcgggcatacctggaaagaaaccatcagttctgtgctttaatccggatgatactgaaacaatatttcgaaatgagggggcctggccgataagatatggactaaactcttacatctattaccaacagaaaatgcgacatgatgtttttcaaggaataggtggtgtgctgtctacccagggcgagaagtggtttgaaaatagatctgtagtcaacaagatcttgatgcagccacgtacagttgatttatatgtggacagtatggacaaggtggctacaagtttgattgataatattcgatatttttcacgagcagatcctgataatatgatgcccaacgattttcaaaatgaaatattcaaatggacaatggagtcgatggcccttataacttacaacaaacgaataggcgttttgaatcgaaacctccaaaaggactctcaagagcaacgatttatcaatagcgttctgtcattattcgatttatcttataaattggatatattgccatcgttgtggccatacatatcaacacccaactggagaaaattcgttaaagctatggactttctcaccgagttgaatcagaaatatatccaagaatgtttggattcgagtgatccaagtattccggaccacgagaaaagtgtgctagagaaactgatcgaaaaagatcgtcgaatcgccataaccatggttaatgatatgatgattgctggaatagatacgactggtaaaaccatagcagctgttttgtattatcttgccaaaaaccccgacaaacaagaaaaactacgccaagaactgaaaacgtatctaccggaaaaaagtagcccggtgaataaagaccttacaagagcgtctccttatttgaaggctgtcattaaggaagccatgcgactatcacctatagcgattggaatccttcggacctctgtcaaagatatggtactgaatggttatcaaataccaaagggtactgaagtaatttctattaacattttaccgtcgagagacaacaa

SEQ ID NO: 95 - DNA, 1624 bp, Rhynchophorus ferrugineus
ggtttgaagaaactaccacatcttctggcgtatgccatgacgcctccacttgcataggaggattcgccagaatcaccacacaaatagaagaattgttggctgccaaaccaaaatctcttctcttaaacggaggggataattttcaggggaccttgtattacaccttgttcaaatggaacatcacccaagagttcctcaataaactaccattcgatgctatcgtactaggcaaccacgaattcgatgatggcataccgggtgtcgtaccattcattaaaagcttgaaggcgccagtgatttgcgccaacatcgatgacagtgatgagccggacattcaaaacatctacactaagagcgtagtggtggaaagagatggcaaaaaaattggaatcatcggtgtcctctatgcaaaaacatatgaaatatcttcaactggcaaattgaatttctatccagaatcagccagcgtcaacgaggaagccgaacgtttggtcagagaggagggggtgttcacgaacatcgtcctatcccatgtcggatacgatatcgatcagataatcgcggccaatgccagtgaaaagattggtctgatcgtgggaggccattctcacacattcctttatactggagaaaatccgcctggacccgatacgccggcaggaccctaccccaccgtggtcaaaagcaaaaacaataaagacgttcttatcgtacaggtatccgcctataccaaatatgtcggaaatatatctgtgtattacggagatgatggcgaggtggtaacgtatgatggatcgcctatatttatcgataacgatatcgttcaagatgaagctacgactgaggcattgggcccttggaaggaaatagtagacttacaaggttcggtacagttaggctccactctggtgaaattatccaaaagcggatgttactatcgggaatgcagtttgggtaacttcgttaccgatgcatatgtatatgcgtatgcccaaagcgccccggccggagcgtggactaaggcggccatagcgttcataaacgcgggcggattacgtgactccatcgaaataggaaatatcacctacagcgacgtattaacggcacaacccttcagcaatacagtggattttggacaactccaaggaaagtacattaaggaagtgttggaacaaaccaccgaacagtaccaaacccagagggtcacgtcagatttgaaactgttacaagtctccggcatacacgtcgtttacaacttaactcgtcctcaaggcaacagagtacaaagcgttaaagtacgttgtcaaaaatgtgatgtaccggtgtacgaaaacttggatctagaagccacttacaacataattacgccctcgttcgttaccggaggtggtgatggattttatgctttatccaataacttgaagaacgtggtgattggtcaaatggatatggatattttcaccaagttcttagccagtcggtctccggtatttcaagaagaagaaggacgaataaccgtaatcagtaataacaatgtcaactataaagctaatgattaaatttattgataaaacctaaattgttatataaatatgaataaaataagtaaaacgaaaaatcttcc

SEQ ID NO: 96 - DNA, 4002 bp, Rhynchophorus ferrugineus
tcaatcttactacacgatcctctacaaatttggagcctacattgcaaatgaagtcggtctctatctgggaatttaaaagctgcaaatttggccactgcctcttggtgtctcattgatccgatcggtcgaataggaccgaattttggtacaggtaacaatagctcgtctacaggacatccatattcatctaaaagcttctgtgaggagtctcctagtccgtcatgggctatgcagtccaccattttccagccaataccagctggtaatgtggattttactatcaacaatacggtttcgccaacttcaactgcaccaatggctcgttccactttattctccggaattatctccatccatgctctagctgcagacatcgcctcgttcagttcctcctcgagctcctcctcgttcagatcctttgaccaaccctctttcatcaaccgacccaccctgtgatttacgcttttctgtgatatttctcctttgagcgctttgaacatggactggctcttgatcaagaacgcttcgtcttgaacctcgcataacaccattcgttcctggtccgatatctgcttcaagtaacggtcctgctgcatcaccaagcccaccgtgtagtacaatctcggttgtccctgatcgtccgacgatgatgataatctgatcccgcatcctgatgttgggagacttatggtgacagaatttgacatggtaccgaattgcttgcattcttgagcgaaatccttagcgaacagaacacctttgaatggttgacccatagacactgtgatgttaacattttgggaatcgcaaactgttgtaatatcggttactttactgatggttgttttggtaggaaacctcaggcttggcgggaaagcagaatgacaggattgtataagtaagtgaataaagtatgccaagaaaatacgttctaaaaccgccatgttgaaatcatctggttcctgctgccgctgatgagaacttcggcctcgccaaaaaattgtctttatagatagctacatggataatagtaactttataaacacattttgaattggaaatcaatacgtctgtcctttttcgagacatattcatcaataactaattcattaaaatttggaatttcttgtgttcatttgtttctcaatagataacattgcgaggcaatttatcttcacccactgtacttctaagaaaagtttttatacgttttaacgtggagaaacaacgttccgcttctgcgtttgttatgggcatcataacaattgcttgtagcaataaaagtctctgaaaaatctactcgcaatttattttcaattataaatttaattaggtggactgttcctgaagcgtccctgaaatctgatcttctgtattatttcaagttctgttttcaatttatccttgttcaaaaaggaaaattcataatcatcctatttaggtttagtatggaaaaattcgttgaaaatatataaaaattttcaactgaagacaagtgcgctatttccggatggccagtgaatgaaaatattcttttgatttctgcaattataacgtcacataccaccttcgcttccacaaccttcgaaacataagaatgtctctcttctgtctttctccttttcctagctttactgtcatcaatgttttctagctcagtttctttaatagtatgtatattatctcgttctttctgaatattttactcaaactcactaatgcatcattttaagattactgaatcagtagatcttttttgcaactgtgaatacaaaatattgacatggggcattatacgatgaaaaattgacaaccaaaaacaaaatttaggatcatacaataatcataaaatagcgcctgccttcgtgatgtatcagattgtctagatgtagattgtattttttccatacacgctataagagactctcggttttcatataccatattaacggttctaattttgaagttccacctggtagcagatgctcttggaactctatttccaactacttcatccaatatggcaactctttgtggagagtatttcgtatttatgcttgctgcctgacatatcaagtttaattgctgagcatagcaatgaacataataggcgtatttaaatttatcttgaatcactttttgaaagcatggacgccatgtggcgccacttatgacgcttgctccatcataactttgagaaatcaactcatcatgatttcttaaaacataatttaacttttaattctgacttcttctatgcagcaagctaaagcaacggcatcatgttcattcgattttacaaaggtccaaaatcgtccaacggggctgtcgttcgataaaatataacggtaaactataaccatttggaaaatattggaaatatcacttgtgtcgtcattcataatggacacaaatagtgaagcagcaatttcttttttgatatgtgcctgacacacggaaaatatacattccaataaattgttatgaatgtcttttgatgtaccttcaaactcggtagcttgctgtaatgatccctcagtgctaaatacagttcagcagaaaaatttataaaacctctaaacataccagggtttacagaatcctcttgttcatcatgtccatggagagcaagctcaaaagcaccacaagcttttatacagtttataattttagatacaacatacctattattttttactttgtcattatgtttttgaatgcttgatcgatattcacaatctaattattgtcaaatatcttgtttgcctaataaattaattcctaatttagcagattaatgtgactttgaattttgatgctttttaattttctcaaataaatatattaaatctctagcgccagatattgtcgattctgatatgcctcgtcgcttccaaataataaacacggaaagcagtaaagactgttaccatactgttactcacagcacaatctgtcatttttctcgtaagcttctgttttaaaagtacgttcatattcacgatttttgcatttagttacattcgtaattaatacacttggtttcggactcccagcacttttaatttttaattcttcttttgaagttgctgtatcactcactaattaaaccaagacaatgttttcttcgcctccgttttggtcaaatggtccatccccagggaatttctataattttcccaacctccatcctcaagttcaaccacaggatttccgacaacattctcagtctccggtaactacatctacttccctggtcggaattgcctatgataaaggtgtaatagtagcaggtgatcttttagcgtcctatggatcattagctagatatacaaattgtccaaggattgttaaaataaataacaacatcattttgggagccagtggtgattatgccgacttccaatatgtaaaagattttgtggaacaaaaagttataagcgaagaatgtttggatgatggtttgtcgctacaacccaaatcactctactgttggttaactagaattttatataacagaagaagtaaaatgaatccattgtggaataactttattgttgctggtgttgagaatggagaaccattccttggtacggtggataaacaaggaactgcttatacagatagagtaatttgcacaggttatggagctcatattgcaacaccactgctgcgtgatgctctagaaaaaaatccacaacttaatctagctgaagctaaggctttaattgaaaagtgcttagaagtattatattatagagatgctagaagctatcctaaatatcaactcggaatcattgatgctgaactaggagtttctatcgaaggtcctttggaagttccacaaaattggaatgttgcatattctattaagggttattaatattaattgctagattgtttattactatttaaaacaataatttgtttgtgattttttcagtaaatttgtatacatttcaatactgtctggaataaatttgatctataataaaaaaaaaa

SEQ ID NO: 97 - DNA, 1042 bp, Rhynchophorus ferrugineus
tcgctggttggactataagaactatttcgatttggattttcccgatttagacgaagaacggaccaggttcaacacttttatcgataatgtacggtccattgaagagcacaacaggctgtatgaactgggagaggtaacgtggacccaaactattaatgagtttacgcatttatcgccagaggagtttagtgagaaaatggcctgttctttgccaatagatattgattttgatgatgttgatgatgatgatgagcgtgttcaaatagttttttcaggtgtaaatgaaagtattcctctatcagtagattggactgccaaaaataaagtaactcctgttaaaaaacaaggaaaatgtgggtcttgctgggcattcagtgctgttggagcgctcgaaagtcaatttgccattaaatacaacaatctagtagaatttagtgaacaaaatatgatcgactgtgtgggcacgaaatataactgtaaagcgtgtgcgggtggtgatccttacggagtgcttcgatatattcatgataatggcattgctctggaaaaggactatccatatcgggcacgaaaatttaaatgccagcataaagaaaggttaaggattagaggttataatttgttgccaaacagtgaggccgctatgcaatacgctgttggtagcgtgggcccggtatcagccacattaaacgctagtttactacagttttaccattctggtatatttaacccgacagaatgtgtcaaaaaacctaatcatgccattctaataactggttacgttagtcaacgcaatacgccatactggaaaataaagaacagctggggaactaattggggagaacaaggataccttcgactcattatgggaaagaatatgtgcggtatcaataattatgtctcctatccgatcttgtaaggattctgttatttatagccttaacaacaaatataggtcatttatcagtacacatatataactacattattggttaatagaaatatatatttgacacaatcatattttttcgtttttacaccc

SEQ ID NO: 98 - DNA, 1291 bp, Rhynchophorus ferrugineus
cgaagtaccctgatctgaaaattatcatgacacaattagttcgaaatatatgttgcatcgaatgtttactgcttaaaaattattttatagaaaaagaataaatatgtttttagtcgcaattttaatatgtttaattagtagtgagtttggatatggtcagtccaggggagagaagaaaactactattcaaatcagacaaggaattttagaaggcaaaactgaatatacagacacgagaaaaatcattaatacttatcttgggataccatatgcagcacctccaataggacttctaagattctcgcctcctcaaaaacatcccggctggaatggtacctatcaagctaaaaatcatactccgagatgtgcacaaatcccaagaggagttaacgacagtgaagattgtttatatttaaatatttgggttcctgcgaattcagacggttatgcaccattaccagtagtaatattcttcgacggaattgatttcagtagaagtagcgagttaccatatcttccaggtcaagattttgtcgcggaagggctggttttggtaacggtgaattatcgattaaatattttcggttttttttgtttgggtacgaacgaagccagaggaaaccttggattattggatcagtattattccattgtttggattagggagaacataaaacaatttggtggtgacccagaaaagttaacactgttcgggcatgcttcaggagcagttagtgtcgctttgcatttaatttctcctagaacatcaggattgtttcagagagcaattatatcatcaggcagtgcggtatctccttggttaagtcacaatgatcctatagcagcctctaaagaagttttgcgtattcttggttgtaatttatacataactgattatttacgatgtttacgatcaaaaaaaacggaagacattttacaaacagtccaagaatacagtgagtcggttcaatatactgatgcctttttaccaatagtcgacaatttcttaccagaaaacaatcgatacttaccttatgaacccgctaaagcttttcgagaagctacatttttccaagttcccatcctaacgggaattagtaaaccaataacatattcacaactaaatgaatggtatgaactagctagcaaaggttttcaacaattgtatcaatatgtggagcgatctaaaataccagatatcctacgagcttataagtttgctaatagttcgaatcgtgaccaaatatttgacttaatcaaatggaaatatacttcttccagtcaagatgat

SEQ ID NO: 99 - DNA, 2846 bp, Rhynchophorus ferrugineus
ttaaaaagtgaagtgtcgaaaaaggctgtcgccatgggttcgttgttccgcagtgcggaaatgacactatgtcagctatttcttcaaagcgaagcagcttatgcctgtgtatccgaattgggtgaactgggacttgtccagttcagagacttgaacccagatgttaacgtatttcaaagaaaattcgttaatgaggttcgaagatgtgatgaaatggaaagaaaactacgttatttggaaaaggagatcaaaaaggatggtattcctatgttggatacaggcgaaaatccagaggcccctcagcccagagaaatgatcgatttagaggcaacctttgagaagttggaaaacgaacttcgtgaggtaaaccaaaacgcagaagccctaaagaaaaattttctggagctcacggaacttaagcagatcctacgtaagactcaagtattcttcgacgagcacgaggggggcgtactatccatgctttgtcgctggcgtcattcttcgggagagaataccggcattcgaacgtatgctgtggagggcatgtagaggcaacgtattcttgcgacaagccgaaatcgaaacacccttagaggatccatcaacgggagatcaagtatacaaatcggtgtttattatcttcttccaaggtgaccaactcaaaactagagtaaagaaaatttgcgaaggtttcagagctaccctatacccctgccctgaagctcctacggaccgcagagaaatggcaatgggcgttatgacacgtatagaagatcttaacactgttttgggacaaactcaagatcacagacatagagtgctagtagcagctgcaaagaatatcaaaaattggtttgttaaagtgcgaaaaatcaaagccatttatcacactttgaatctattcaacttggacgtcactcaaaaatgtttgattgctgaatgctgggtccctgtgttagaccttgagaatatccagttggctttacgaagaggcacagagagaagcggtagttctgtcccaccaatcctgaatcgcatggacacccctgaagaccctcctacttacaaccacactaataaattcacatctgctttccaagtattatatgattcttatggcattgcttcctatagggagatgaatcccacgccatataccattatcactttcccattccttttcgctatcatgtttggcgatctcggacacggttccctgatgacaatctttgccgcctggatggttttaaaagaaaaaccgttagcagcgaaaaaatccgataatgagatatggaatatattctttggcggacgttacatcatattgcttatgggtctcttttcaatgtatactggcttaatatacaatgacgtttttggcaaatcacttaatgtatttggaacgagttgggcagttaatctaaacaaaagtttcgttgaaaatctcaaggaaccttacatgttagatccagctaaatcagattatataggatatccgtatcccttcggaatggatccagtatggcagttggcaaaaaataaaattattttccacaattcctttaaaatgaaaatttcgatcattttaggagtaactcatatgttgtttggtgttgctattagcctgttcaacaacttatacttcaaaaataaactgggcatcatatgcgaatttatccctcaagtaattttcttggtattcctgtttttctacatggtaattctcatgttcattaaatggatcaagtactacgcgaattttgatgataaaacccggggctccagttgtgcaccctctgtgctgataacattcattaacatggttcttagcaaagatacgccatatgtaaaggaatgcgaaactccaaatatgtatgctggtcaggatgctatacaaaagtttttgctaacgtgcgctttcatctgtatcccctggatcctgttagccaaacccatcatgattatgagaagcaggaaggctgccaatcaatattccgtaacccataatcaattgaattcagctactgaaaatggtgatgctgaacaaccaatgcataacaatacatctcaaccaccacctgccgcgcatggaggtggtcatgatgaagaacctatgagtgaaatttttatccaccaaggtattcacaccattgaatatgtgttgggatctgtctcccacacagcatcatatcttcgtttgtgggcgctttctttagctcactctcaactctcagaagtgttatggagtatggttttgaataagggtttaacagtagatggatggtctggaggcattgctttatatataatctttaccatttgggcctctctaactgtttctattctagtccttatggaaggtttatctgctttcttgcatactctccgtctgcactgggttgaattttgtaccaaattctactctggaaacggatacgcattccaacctttctcatttgaattaattctcgattcagcctcccaaagcaaggaggaataaactgttaaatcaggtacacttttattttaggagttaattaaatgatcaaacatttacgattagagtaatattggacttttttattttttacatgttatttcagaatgacataatcttttgtattgtagttcacatacagcatacgagctgtatattataaacagtaactaatcataattttaattcttaattgttatttatagtatttaaattaagcgcctgaatggcatccttgaaaagattgcaagtagcttattgaaaatattagtgttcactgtgcataatgatctttataatccatagtgtaatacttctgaaaaacatgtactatataaatgtttaacgc

SEQ ID NO: 100 - DNA, 1537 bp, Rhynchophorus ferrugineus
atcgttggtatgttgactgttgatgatgtcgttcgcgtgcgagtgtctaataaacagcagttaaaaacatgtgaattagtgaacaaatatgtcgttagatgatttttgctacgaggagaaactcccatttgtgaaatacttaaacgagaaggtgttgttatattgtattactctgctagctttcgctggtatttttctcctgatatgggtcatacagaactatacattcttcgaaaaagccaaaatattacgtggatctcttcccaaattgccatacggtaacctaaacaatgttgtcaataaagacaacaccatatacgaaatgttatggaaaaattataacagattcaaaagaaagcagtgcgatattggtggtgtgttcttcttcactaaacctgtagtggtggtggtcaagcctgaatacatacaggaagttctagataatagtgataactttaaacaagtatttcctgaacaggtcagtcaaaatataggtgaaatattcacgtcgaactcggcaaatagttttattcaaaagtaccgagaatctttacgcggagtgttatcagaaaaattgcagaactatgactttagtacggttctgcgcagtcacctgcttgaaatggcatcgctggcttttggactcaattcacctagtctcgtcgaagaaataaaccacatcttgaaagccaaaactgacgcaaaactaaaataccatctggggttgtgctatcctttactcaaaagtcgaaacagctcgttgtatcgaaatttaaattcactattcgttgatattacacaagccaggaaaacaaatgataattcgtatgatgatattattcaatattttatggattttcaacggaaatcctccacagaacctaaaataataagtcgaatattgtttgacttatacgcagatgttttaacacacacctattcagttgttttcgcttgtttttgtgaattgagtaagaatgaggatgtccaagacgagctacttggtgaaatacgacgatacaataaaaaacattcagtaatggatatagacagtttaaaggaacttgaatatttgaatgcagttgttctagaaaccttgaggaaatatccaccagttcctttcattctgaaaatagcccaaaaagactttacattgaataacgtacaattccccaaaggagttttaactgctatatcaatccttggtattcataggaacccggacaactatacgaatccagaagatttcgatccggacagatttgctgaacaaactaacagtgcctttctccctttcggaaataaaatagaagaaaatgtttttaaattggtggtattatttaccaaactcctcatcattgacaccttgacggccttgaaagttagcaggaagaatgactcgaacgctgtgttaaagttcgaccgcaatctcattcctctaagactttctgagtcttatctattaacgtttgagaatctttagttgtaaatatgttgagaattgaataaagagacttttaaaagtgtaaaaaaaaaa

SEQ ID NO: 101 - DNA, 3332 bp, Rhynchophorus ferrugineus
ccacgctatcgcgacgatcagaaggtgattttgaatagttgcttgtcgaataaaaccgcgcgtatgaatggtacgtgtatttaaaacaaacagaacacccgagtatccagtatattctttgccttaaaaatataaatagttccgctacatgtcgaaataaagcaaccaaaaaggaagaatatgttattaaaaatcaccagtgttctgttgacgatagcgtcactatccttgccagtatctaccgcccccgtaaaatttgatgaaggactcagtttggttatattgcataacaatgatatgcatggaaggtttgaagagacagctaggaattccggtacatgtcaacctaaaaagaagaacctatgtgtcgggggttttgctagaaccgctgaagttataaggaatttccgacaagctgcagatgcaggaacatcacctccagtactttatctcaacgcaggtgatacctttacgggaacttcatggtttagcgtatttacatggaatatatcatcagcctttgttaatgcccttaaacctgatgttgtggccttgggaaaccatgaattcgatttgacgccacaaaacctagccaagttcgtcaatgcagtaaacgccccctttgtagcagctaatttggacatgaccaacgagacagtactcagtaaagtacagaaatccgttgtccttcaaattcaaggttatcaagtgggtgttgtgggatacttgacgccggaaacagtcaagatctctttggtggggaatgtgaaatttcaggatgaagtagaagcaattcggaaagaggctcaaaagttaacagacgaaggtgttgacatcatcatagctctcggtcactccggttatgaaatggataagcggatagccaaagaggtagctgaagtagacattgttgtaggaggacatacgaatacatttctgtggaatggagaacaacccgatgcggaagccatagaagggccatatcctaaaattatgactcaagcatctggtaaaaaggtaccggtggtgcaggcttatgcttacaccaagtatctgggggtgctaaacgttacatttgatactactggaaaattagtagaactctctggacaacctctgtttttggatagcagtgttaatcaacaacctgatgtgttagagcttttggaggtttaccgaccggcaatcgatgaactcaataacgagaaagtcggtgtgtctaaagttacattagacggaagctcttcggtgtgtcgtcaacaagaatgtaacctcggtaatctagccgccgatatccacgtatcttacgtagcatctgtgtctacagacagatggaccaacgcccctataggaatatataatggtggaggaattagaaataccatcattccagacgaaaatagtaatgaagtaactcggggagatcttctgggatcatttcctttcggaaatcaggttattgtaattacattaaatggctccgatctactgtatgctttagagcaaatggtacgatcccaaggagaaacttcaggtggagaattccctcaagtatccggtctacgattagtgctcgatatgtccgaacctccttattctcgggtaaaagaagttagagtgagatgtggcttatgtgatattcctagctatgacctactcgatgtcaaaaagaattacactttagtaacgtcaagttttctttcggaaggtggtgatggaattactacgttcaaagaaaaagcaatgaataaaaaagttcaagatctaggcgatctagatatgatagtgtggtattttaataactacagcccactatacccagaaattcaagacagaatagtatttgtcaataaagggagcaaaagtgctggtgttaaaagtaaagacagttttacaactgtgataataggtttaataatatcccaacttttatggagattgggtacatagtaagtagtaaactcctactaatattgtataaagtaataaataaaattgtttattttttgtatgactagcaatagaaatcttgatgttctcgtaataatccacgtggaccttcagtatattcacataatccaaatttcttcaataaaatacattttgttttgggatttccccatttcccttcgaaactcatccagggctgtatcatagttctcccaaagtggtgaaattctactgaattccatgttttccagggagtgccgtaatcggtcttatctcgaattctgggtactcgaataaattcgtgctcacccggggcagaccaaactccatgagaccctttagctgcaaataaaactggatgtccaccttgcaatcttatatatgccggatacgtaggaacttgggctacactttttctaggcatttttgattcaaatttaaaaacattattgtcgcgttcgtatgtgtagtatacgcctgcgtcatgcacagatgctcccaatctccgatgtgattacccaatttgcgataatggccaaaacatttactaaaaattaacggggcaggtactttacctaaaaaacaaatttcctttccttcgttatatggataaaacatccaatatgttacttgaaaagaaggaagcagttctgattcctcagaataggacaggtttttggttaaatctgtcatgctgataggtttacagtacgttattactgcataaacaggaactgtagggtgtatttttggatttctgccgtataaaaacgaggaagcattccctttaagataatctaaaggtttcttgggaacaagatatgtcttcttgaaattactgtggtaatacatcgccaaatatttcccatgatttagaacttttccagcttcatttactatattcatgtggttcaagaactcttcgacgctaagaggcataaacttttcttcttccgatagccaaactaagggggcccattgttttactaatgcttccacttttccttgataccattgttcctcagaagcacttaaaaaacttgcaaacaaaccgacgacaaggatttctttaatcagcatgacttggaccgccaccaaacattcttttgtttttgttttgtccagcgacgatcgactcaaccgaactaggatttaccatcaccaccctgtcggcgtcggaccgctaatcacctcatcaacaaacggtcgaggaatacggtattcgcttgcggtccctcttttctttttctcgctcacatagtggaacagagaaagtctgattgatgcggtgaccgaattaaatgcattaaactaatcaagtcggcgttggtttaccgtggttaggactgcgtccgttcttgtaagcttgcggaatattgttg

SEQ ID NO: 102 - DNA, 226 bp, Rhynchophorus ferrugineus
tgtcaatgtacctcaaatgattacgattactttcaacggtgccgtaaatgttgataacatcgatctttatgaagaaatcttcaacggacaaagagctaaccctaatggatgccagataagaggaaccttcttcgtctcgcacaaatacaccaactattctgccgttcaggacttacataggaagggacatgagattgccgtattttcactcactcacaaagaagat

SEQ ID NO: 103 - DNA, 798 bp, Rhynchophorus ferrugineus
tcactattcgccagttaagtgcagcggaacaatcattgtccatcatgcggtcgatctatggattgcttcttgtcgtttgtctgttggggatcaacggggaaaaatcgaaatcgaaatctttacccagctacattaaagcttgtagcagatcagctgacttgtctgcttgtgctttaaaacacggcacggaaagtatccaacatattttaaaaggtgacagtaactttaaaagcccctcattaacaccttggttcttggaaagggttgaagcgaaaaccggtggtttggagctaactttaaccaatgctagtgtacatggtttggagaaaaccgtcttaaaaaatatcaaaattgatgtagataaaaagcatgttgaccttcagaatttatttttaatgactgtacattcgattactcattcgattatgaattaactcagaagaaagatggaaaaacctacatggcaaatataaaacctaaaacatcttttaaaatagaaaacggtcactttcaaatagataatttgtttgatggaaacaaagctttaggtgacaatattaacaaggttttgaatgaaaattcccaggaagccataggcgaactaggacaaatcatttcagatgtagttaatctggccgcaactacgataattaaatcctatttgctatctataccgttcgatgaaatcattcttccataaagcgtattaaagccaaatatactttgtaatgcgtttgcctacttcggttgtaaaatttatttttttgaaataataatattaaaaagagaaaaaaaaaa

SEQ ID NO: 104 - DNA, 1702 bp, Rhynchophorus ferrugineus
cttttcgtacgcagaaatgtatcgttctccgttctattgatcgttgacagaatcagcggtccacggaagatgtacctatatccgctgttgttcacctggtgctggttgatcggtgtttccggcatttcccgcgcggaatgtccggacgagcgcgtcggtccggtagtgcgggcccccgacggctccctcaggggcaaggtgctgaagacgcgcgagggccgggatatcttcggtttcctgggcattcctttcgccaagccgccgctgcaaggtttacgttttaaggctccaataccctatggtaaatgggaaggaacattaaacgctacccaggtccatgcaatttgtccccagcgcgacatctatagaagatcggagatcttcgaaggcaacgaagactgtctttacttgaacgtttacagtccgcagcttccgtctgcctcgtcacgtttgttgccagtgatggtgttcttccacggaggaggctggttatgtggtggtggaaataatttatggtatggacctgatatactcttggacagagatgtggtcttggtggtgactaactaccgattaggtgccctgggttttctcagcacgggtgattcagtggttcccggcaacaacggcttgaaggaccagaacctcgccctgaaatgggttcagaggaacataagggctttcggtgggaacccgcagagcgtcactattttcggagaatcagcaggaggggctagtgttcattatcatatggtttctccaatgagcaaaggcctcttccatcgagtgattgctttgagtgggacatccttgtgcgtctgggcgacagcccccaaaaacgaaaacgtccaaaactccaagaagctggccgagtctctagattgtccggttggtgataccaatcagatggttgaatgtttaagaaaacacgatgccaacgatatagttaaaagagacgtggtttttatggagtgggatttcgacccaatgattccattcaaaccgaccgtagagcccgacgtcgaaggagccttcctcactcagcatcccatagatgtggtccgagaaggaaaaagtgcccctgtcccattgatcatcggtattaccagtgaggatggtgctctaagaggtgccggaataatgaacaacaatcatctgttggaggaaattaacgtccatttcgagagattggcgcctatcagcttgatgtacgacaagaccgcaaagaacatcagtaaaatcaccaagcagatcaagaagttttatttcgataataatcccattgattggtccaagaaacaagaagttgtgaacatgtacacggacggttggtttctcaactgtgccgatgaagccgtcaggctccacaagaaccatacccaacatcccgtctattattatctattcagtcacagaggatccgcgagtaccactttatttgccaatttcgcctacactggaaatcccactcccaaactctccagtgttgttccggaaaaatggcttccggtggaaaccgacgatatggagtacttccatatcgatgccacgtctccgggcatgaggaaaggcctgttcctggagagagcacagttctggaggaatctagaatggtaccatcgagatcaccactcgacttccttcgtcaaagacgagttataagtattttagattagtctgtatatatttgaaagtagtttaa

SEQ ID NO: 105 - DNA, 334 bp, Rhynchophorus ferrugineus
tagctggttttgatactgtgtctaccgctatctgtaactgctgttacgaactggctatcaatccagatatccaagacaaactgcgaaatgaaattaagaaaacaatgaaagaacataatgagaagctaacttatgaatcaactttgcgtatgaaatatttggacatggttatcacagaaaccttgagaaagtatccaggactgtctgccactgagcgtgtatgcgttaaaccatacactatcgaaccagtatacccagacgaacagccagttcacctaaatgttggggacattgtcttcctaccaccatatagtctccatcacgatcccaagta

SEQ ID NO: 106 - DNA, 1312 bp, Rhynchophorus ferrugineus
atcgacgaaaaggcatcatgtaaggagctagatcagtggatagaacaactaaacgattgcaatcaattaacggaaaatcaagttaagactttgtgtgataaggcgaaagaaatattgtcaaaagaatcaaatgtacaagaagtaaaatgcccagtaacagtttgtggagatgtacatggtcagttccatgatttgatggaattatttagaataggaggcagaagccctgatacaaactacctatttatgggagattatgttgatcgtggctattattctgttgaaactgtcacattactagtcgccctaaaggttcggtataaggaaagaatcacaattcttaggggcaatcacgaatcgaggcaaattacccaagtgtatggtttttatgatgagtgtctcagaaaatatggaaacgcaaatgtttggaaattcttcaccgatttgtttgattacttgcctctcactgctctagttgatagtcaaattttctgtttgcatggtggattaagtcccagtattgatactctggatcatattagagctttagaccgtctacaagaggtacctcatgaaggtcccatgtgtgatctactgtggtccgatccagatgatcgcggcgggtggggcatcagtcctcgaggtgccggttataccttcggtcaagatatatcggaaactttcaatcactccaacggattaacattagtgtccagggctcaccaactggtgatggaaggttataattggtgtcatgataggaatgtggttaccatatttagtgcgccaaattattgttatcgctgtggtaatcaggctgctataatggaattagatgatgcgcttaaatattctttcttacaatttgatccggcaccaagacgtggagagccccacgtgacccgtcgaactcccgactatttcttgtaatttttacatatttgtcaatcgcaatatcataaaagtttgcttagattatattgtatatgttaacaattataaaaaccgcaagcggaatagcgcgcgatgtaactgttattatgggaaactaaatttagtgaaactataaaaataaaaaattcgtacaagacattacaaacttgatttaaaatgtattctttgtcaacttacttgcattggtttgatggatctttgaagagttttattattaaataaatacgatacaaattgtggttttctgtactgattcatattaatggaattaaattcctgtctttgaacaattttaattttaaggtaatcctcttactagcgacatttctttcttttttaaattgtgaatgtagttata

SEQ ID NO: 107 - DNA, 1142 bp, Rhynchophorus ferrugineus
gcagaagttgataaggatagtgtggagatctcgaagctagtttccgtatatacactaaatgtgatttgtgaggcagctatgggattacaaatcacagataaagacgaaacccatctaaaatacattaattctattcgaaatatttctaacattattagctgtcgatttgtttcgcctctaactaaagtttatccataacttcattgacaattatataggtaaaaagaaggaaaaattgaagacatatattaataacgaaccagaagtcaaagaaactctcacagaatctaaagaaaaactcgtttttcttgatcacttaataaaaaccacaattaatggaagacccttaagtgacatagagcttagagatgaggttaatacatttatgtttgaggggcatgatacaacgtcttcagcaatctctttctgtttatataatttatcgcttcattctagtgtacaggagaaagttttgcaggagcaaaagtcccttttcggtgcagaccttaaaaaggctacaccaacgtataaccaattaaacgaaatgaaatatttggaaatggtaattaaagaaagcttacgattgtttccatctgttccattagtagcacgacgattgtcttcggatcttaactacaatggaacagtatatcccaaaggattaaacgtccttctttatacgtatggtatacacagaaatccaaaatattacactgatccagatcgatttattccagaacgttttgaaagcaataatggaaggttgccattttcctatcttccttttagtgctggacttagaaattgtatagggcaaagatttgccatgttggaacttctctcggtcatatcaaaagtgatacgcaattttgaattgaaaccagccaatccattccatgaagttgagctttcggccgaactagtcctgatatctgtaaatggtataaaaatatctctttctcggagaaaataaacacttaatagctgtacatttgttagttatgtatgttgatttaagtgactaaatgttattaattaaaattgataaaataaatgatgttcttatcactttgttttaacctttcgtattagatgtgctgtttaattaactctggtgaacacgctgagtacttatgttaagt

SEQ ID NO: 108 - DNA, 1889 bp, Rhynchophorus ferrugineus
gttattcaatactgaattttcttttcacttatcttatcaattttgtaatattatattgcacaatatgatttcattaaattaatgtaattgaaaaatgcaacatataatgcaaatataaaccgcagttctgagtaatgactaaaaatatattgtttataattatatcgttcattaaaaaagtgaataataatttaacatgttatactatttgatattaatagtgatattatttatttatttcttatattctactctatattcgaaaccgtattcctactggaaaaagagaggagtaaaacaaggaaggccatggattctctttggagatagttggccattaatttttcgtttgaagaatatagcggaaaatgcttcttattattatgaagaaatgaaagatgttagatattatggtatatatcagtttttaaaacctaaattaataatacgcgatcctgaattgataaaatctgttactgttaaagattttgatcattttactgatcatgttgctatggtagagccaaaagctgatccgctatttggaaaaaatttattaatgttgaaaggagacgattggaaaagtatgcgatcgatgttaacgtcatcatttactagcaatcgcatgaaaactatctacaaattgatttcagaagctgatgaaaactttattcaatattttttgaatcaacctggggatatcatcgaaattgaagcaaaagaaacttttgcaaggtataccatagatgtgattgccactacatcctttggtgttaaagttgattctttaaatgatagaaataacgaattctttcgcatgggaagtgaattggcgaatatcagtttcacgtcatttcttaaaatcctacttcggcaaaatttaccaacattatataagatgtttaaaatgacaatgttcagaaaagaggtaaacgatttttttacagctctgattagtgatacagtatcaacaagagaaaaggaaaatatatatcgtccggatatgttacaaaatttaatcgatgccaggaaaaaaaatggagagaaagagagctttaccattgaggatatcactgcccaagcggctattttcttctttgccggttttgactcggtttcttcagtaatgagcttcactagctatgagttagcgcttaatcaagatattcaagacaaactgcgtaaagaaattttagacatttctgaagaaaatgatgggaatattacctatgacgtcattaagcaaatgaaatatttggatatggtaatttgtgaggtattaagaaagtggcctccttttgtcattataggtagagaatgtactaagacatatgtgattgatccagtttacccaggagaaaagaaagtagtagtacctaaaggaacagcaatacaaattccattatacgcaattcatcacgatccaaaatactatcccgatcctgaaaaatttattccagagcgattcggcacagaacaaaagcatcaagataaatattttccatttggtcagggtccaagagcatgcttgggatcaaggtttgccttgatggaaataaaaacaatttttgttcacatattgaaaacatttaaattggttacaacagaaaaaactcaaattcctcttaaactagtgaggaagttttctgtgaatgctcgaccagaaaatggtctttatattggtttacagaagttatagttacatatttacattattatatattaaatgcaattaagttaactgattagagccagttaactttattttttatattatacaatcaagggaattgtcaggtctagttatttaagccccacattttttatatcttactttggtggactttaaaactaattataaatgtttgggattttgataagttgtttaa

SEQ ID NO: 109 - DNA, 1105 bp, Rhynchophorus ferrugineus
tgttccacaaagccatcctgcaaagcgggtgttgtctgaactcttggttctggggaagaaagaacaacgctagggagatcgttgaagcgatggggcttcaagcggaaaccgaagcggaagccgtgaggattctccgaaatgctccagtaaatgatatattcaaggcacagaacaaatttcgtgatgtcctttttgagtgtttggttcccctggaacgaagaccgttctctgctgtcattgaggtaccgaatcccgaagcgtttttgtcggaaaatccggtagatattattaaaaaaggaacctacaatcatgtacctattatttttggctataacgacaaagaaggcttgctcatagagcttgaagtgcttgctaggaataatatcgattcagcggcacgtaaacttgatttgaaatgtcttattccatttgaatcggatgtggataatgatgaagatattcttcaaataactcgccaacttcaaccgatatattcatcagattcaaacagtcgacaatacgatgagtatactgatggtaacttcatgataggcattttggagtcaacgaggcttcacaaactgacaacgacagctccaatatacctctacagaggttccatctccaccgagttgaattttttgaagcgtatgatgaacaaaatcgacgaaccaggctgtggacacgcggatgaattgggttatctatttcgtacagaactgagtccagttatcgaaccaaatagtatagaagaacgatcgatgaagaatttcgttacgttgtggacgaatttcgccaggtttggtgacccgacacctgacgaacgattgtcgatcatatggcatcccgtcgatgatgcggacaatttaaaactactgaatatcgatagaatattggagtatagggaggttcccgaaaaggaaaggtttacagtttggaggaaaatactgaaaaaatggccacttgtgaaatatcattaattattgtattcattttaccctaaaatgttatttgtgtcttcgaattgttttcaattttaattgtttttttttgcaacaaatcatccagtatattgttattttataaaaaaaaaatgttttattta

SEQ ID NO: 110 - DNA, 2320 bp, Rhynchophorus ferrugineus
attatctaaaatgtataccgtcctgaccattttactctgtgccgtgttatattgtttaatttatattttattaaaattatatgccaaatgggatattatcaaattctatatgaaacataatggtcccagatattttccatatttcggaaatatcgttttttctggaaataatgtactggcaacatatttgaaagtcagacgtgattatggaatgccttacgctatctggattcatgatgatctttgttatgctacagatgatcctaaagaaattaaagtgattttaaaccatccagattgtttcaacaaagcgacattttacagtaaagtagttgaatcatgtcttttcgatgggtttgctttaatacctatatcagaaattgataaatggaagttatacagaagatttgcggcgaaaagcatgcgaccggcaatgtggaaagactttttgccagttttccatgaatacagtcagcgtctaaaccggtccttcaaaaaatccaagcaatttaccaatttcgacgattttttcgctagcttaaacaacatcgttttccaaacctttatggtaaactttttgggaatggaaaattaccatatgagagacatcgataacttcactacaggaattcaaaaacttttagcagttctcggacgaagaaccacttttcaacgtgttattcccgattatttctggaaatatcatacagaaaatggcaaggatttctgcaatataatcaataccattcgaaacgaacaatgatactttgaatagtaccaaatttctaaatagctatctacaagacgaaggtaccgtatttacagacgaagagatattccaccaagtatatttcctggcagcagcaagtactgaaacatcagctttaagcgtctgttttattttgttgcagcttggtatggatcaagacgtacaggagaaagtacatcaagaaataattgatttacttggtacggataaagaaattgctcttcaggacttgaacaaacttaaatatactgaacaagtaatatttgaaactctaagaatctatccagtattgcctttcttaggacgccaagctacatcaaatatacgtttagatggaaagattattcccaatggtactaatatcattgtttcaccatatatgatacatagaaatgaaaaatattggcctgattgtgagaaatttaatcctgaacgatttaatgcagaagaatcaaaaaatattgaacctggctcatttgtaccatttctcttgggacctagggattgtgtcggtcgccactatggcatgacgatgatgaaggtatttttaacaaacataataagagaatttagaattgttgcgagaaaacaaagcatcgatgatatgaaactgagttactacattacgatgaagccaaccagcaatgtcgatttacaattcatacaaagagctccaaatcattaatattttgtttctatcaataaattaaacatatgagactatttttactaaaatgaaacatgtataacattattgaagaatgcatttcaacactttattatgtacataatactataatgtttatttgttcagcgctagacctattttctgtcatccacttgatggtgtttggtcctgactagttggattctggacttttaaaatttactaggtcgtgccaattcacaattatttttatcaatttgaaaatttaccaaatttccaactatactgaatgacattctgtaacattttgctatcaaataaagacgtaaagtaatctggaaaataatatatgacttcgtaaaaatagcatattgcatagaccgataacttcaggctccgcctatcccaaaaatgatccttcctaaatttcttaacttatacaacctacattatatccgaacaggtttccttatatattaaattaatcacgtcaaatagataatcacatcaaatagaggaataaaaatataaaaaacaaaaaatgagtaataaaatccactactcacctactataaaaagagaaacagaacaagatatgacggaaagggttttcctagcagtcctctaatatcctcagtgaacaatataccgggttggtaaagtattaaagaattcaaaattatcttcaaaccatccaggtagatgcgaaagttaaattcagaaaccaatagttcagatataaacgaccgcataagtctcaaactaaaaaattgttgtttgcatttcaataaatggaataaaatataagtatatgctttataagagagctttggtatgaatatataatagttacagtatatcgaagaagagattctggacgcaat

SEQ ID NO: 111 - DNA, 1633 bp, Rhynchophorus ferrugineus
cgacacatcaacaagtcatcgcactgttgtttacggtggggctacatcacggtagtcagcaaatttcatttaaaatcgctactcattccgatacgttatctggtacctccgggtactgttatttaagcggaatgacaagtcggctcggacagtcccgaaaatgattttaataataatagcggtggcgctcattgccgtttatgtgtacagcaaatatgatcgcacatacaactactggaaacgaaaaggggtaccccaactgcaacccgtgttcttttacggtgacgcgaaggatttcctcgacgggaaaatatgcgaagcggagaataccatgaactattacaagaaattcaaggccaggggtctacgtttcggaggcgtttataacgagaaacgaccggagtgggtaccggttgacccggaactcatcaagacaatcacgacgaaagactacgagtacttcgacctccattttaggaacatcagaaaaacgctgttcttcaacaacctgtttcacatgagaggcgatgaatggcgcaacatgaggagaaaattaactcccgtttttaccacaggaaaaatgaagatgatgtttgatacgttggcagataaggctgatgggctatcagtactgatgcatgacttggagaaaagacaaaaacctgtagaacttaaggggatatcgatgagatataccaccgatattataggctcttgcggttttggtatcgaatgtaactccttgaaagacgaaacttcggaattctatgtacaaggccaaaaattattcaaccagaccagcgtcaaacctaccttgctccaaaaaattgctcgattcatcaacgtattaccatctaccgcactttatgcacttgatgatacagctgaaaaataagggaaccattaccgaaatttcaaacgcagacgacgatgtctatgataagacagttaatgaagatggaatcggatttgaagaactcgctggtcaggttttgctgttcttcaccgccggatttgagacctcctctacaacaatgtcgttcgccttattgcaactgacacagcatccggatatccaggagaaaatgcgagaagaagcgagaaggatattcaaaaaattcggtgggaaatttacgtacgagggtgttcaagaaatgaattacatcgaatgtgtggttaaagaaaccttgaggatgtatccgccgttggctatacttccacgagtctgcacaaggaattacaggataccaaatacggatgtcatcatcgaaaaagatacgtcgttgagaatctctgtttggggtttacataccgatccggagtacttcccggaaccgttgaagttcaatccggacagatttagtcccgagaataagcataagatcaatcctcatgcctatattccatttggcgatggaccacgccaatgtttaggtatgagatttgctctgttggagtctaagctggggttagcggtacttctaaaagacttcaatttttcattacataagaccacgccatatccacccaaatacgtggtcaataattatattccaactgtagaaggcggtgtgctactgaacgtcaccaaagttgattaggatagtgagcagtgattactatgaagtcggaa

SEQ ID NO: 112 - DNA, 1789 bp, Rhynchophorus ferrugineus
tgacttttaggaaaacgatgagatgcaaataacatcgctgcgtgtttctgtgtaattatatgataacataatttgtatttaagtggtacggaactattcactttataatttaacagttggttgtgctattagtcggtacgagagagtcgtcagtgagagagcgcgaattgtgcgagattttttttatcgactcagtagtttttacgaacaacagttaacaatgattatacctgtcttggctagtatttgtgtactaatactgactatatggttctacatcaaaaatacaatgtcatattggtccagacgcggtgtgatacaaatagaaaacaaacatttttggtccagggaattcttcgggacaacaatccgtgataagtaccagtacggtaaatctttaaatcagaaatatatagggacctatatattcagttcgccagtctttttccccatccatccacctttgattaaaaacgtaatacaacacgacttcagccatttccgcggtcacggtaactacaacgaaccaaaagacatcctctcgatgcatctgttcaatgttgagggcgagatatggaagaacttgcgggttaaactgacgccaacctttacatctggtaagatcaagatgatgttcgaaactttgctggagaaaactcacgggttggagaaggtggtgggggattatgctgacaggaaggcggcttgcgatattaaagacgtgttgggtcggtttaccaccgatgtgatcggaagctgtgcttttggtatcgagtgcaactctttggaagagccggataacgatttccgatgctatgggaagaaagttttcgaacgggcaccatctagattgttctatgtcattttcataccgcactggatactgatggcttcggattttaagtttcacggcaaggaggtcacggatttcttcaccaatctcgtgaagagtactattaagtaccgccaggacaataacatagttcgaaaggacttcctacagttactgatacaaaatgattatgtaactgtggacgagatcatcgcacaatgctttgtattcttcctagctggcttcgaaacatcttcaacagctatgacgttcgccctgttcgaactggccagcaatcagcacattcagaaaaagttacgagaggaaatcgaggaggtcttgaagaaattcaatggaaacttaacttatgacgctgtgattgaaatgaaatatctggatatggtagttaatgagaccttaaggaaatttccaccagcggcatcaattccccgagtgtgcagcaagaggtacaaagtccccgattcagatctagtcattgaaaagggcgtacgagttcaaatccccgtctggggcctgcacatggacccggagtattaccccgaccccgaggtgttcaatccggaaaatttcagcgaggaaaacaggaacaagcgcccggatttcacgttcttgccgtttggcgaaggtccacgaatgtgtatcggtatgagattcggcctgctacaaactaaagttggcctaatcagcttaataagaaatttccactttacattgaacgagaaaacaaaaactccactggagatggaacgaggcagtatcgtactcgtcgcaaaaggagatatatggttgaatgttaagagaatatgattgcaacataccttcagtaatttttaccaaagtgttaatgatatttagttattttttaaataaaacatagataaaatataatgttatatttgtattgttatatattctttaatatataagattggggag

SEQ ID NO: 113 - DNA, 1797 bp, Rhynchophorus ferrugineus
tgattgccatccttatatatatttgtatcttgattagttaccatacgttagattgtcagaattttagcccaaccattacactctcaaatggacaactacgaggtactgtaaacaaaactgctattaatggtaaaacttactatgctttccgtggtattccgttcgctaaaaaacccttaggcgatttgagattcgcggctccagtacccaatgatccatggactggtgtgttggatgcagtagcggacagagatgcttgtacccagttgaatatcctagaacatttcaccaaggaatcaaatgttgtcggatccgaggattgtctctatataaacgtgtatacaactgatctaaagggaacacttcctgtgatggtatgggtatatgggggtacattttggagcggatcctcacgttatgaggagtttgcgcccgattatctcctggagaaagatgtgttatatgtagcttttaactatagattaggagtatttggattcttaagtactgaagatgacgttgctcccggtaactggggattaaaagaccaaattctcgctatgaagtgggtgaaaaaaaatgtggcagcatttggtggcgacccagaaaaaataaccgtctttggacaaagtgccggagcagcatcattgtcgtatttgttgaattccaaattaactgaaggtttgtatcgagctgctattatgcaaagtggtaacgccctatgtacatggaccttgactagacaagcgaagtccaatgcagacaagctgggtttactattaggtattttaccaactgattcgaaaaccttagtgaagcgacttcgggaagtcgattataaaaaactgaaagtggttgaaaatttggcaacattttctatctggcttagtggtaatattataaatggatttccgttcgctgtcgttcaagaaccagaacatgaaggagctgttctatcagggaggagctatcaaatactggagagtggaaattttgttcgtgtaccagcaatagtcggattcacctcttttgaggttgcacctggtattcatatcaatttactgttacgtatttttgctattattttgctcaatttgaaaattaaaccactctcattggctccatatgaccttactaaagacctgtttaaaaagattcttgctggaaccatgattagatataaatattttaaattatcgcctctaggcctcaacgaacaggacgcctttaagtgggctacagtggatgaatttaacaggccaataagggaagctgctaccctcatgtccaaatatacggacgtttattattataaattctcttatcaaggacgtttgggcaatcccaacagaacagagccaggagttcaacacgcagaagatttaaaatatatattctacactaatgcaacagtatctccagaggatgcattaacaataaaaaggatggtaaccatgtggactaattttgcaaaaactcgaaaccccacattatcagacgaatctgatgtgttgaagatcacttgggtaccgaacacaccacatatcgatgcagaaaagaacattacatatctgaacattaacaatacgctagccctgcaagaaaatccggatcaagatgattggttattttatcaaaatattttcaaggattttggagatccctcctactacgtgacatattaaaatatttataatagttattgttatactgccactactatggaattaattggtttttacctgtatgttgatgtagggtttattgggcttatatggattaaaaatcaatcggtga

SEQ ID NO: 114 - DNA, 3086 bp, Rhynchophorus ferrugineus
atgttgtagtgcatttaaataatactgggcgtggcgtatagtgactaacaaaacccgaatatgtataataccatgtggtagttaaagaaatctatcgttaaggtgtgcacgtataccttcgttcagttttcacctaagatgacgtcacataggtaaacgaaacacggtaaacataatcaaatatggcgccgacaagacaacaacagattgaattagttttgttattagtgatagtgtttgttagtgatattattttgggacaatatgatcagtacgaatatggacaatatcagcacaatcaatataatacatatggagaacaactaccatacaatattcctaatcctggtgaaaaagactatcgaacttttatttataaaggccgtaggtatggtcaacagaacaattattactatgggataccaggggactcaagaattcgaggtcaagacgagagattttcttatgacagacaggggaattcagaaccgattctgcctggaattcttggtggttggagggaggatttacaaggaaaacaacgtgaacaaactaaagaattacccagggatgtttttgtgaaaactactcatggcgatgtacagggatttcaggtttatctttttgataacccagatcctgactcactctatcgaccaggatccgaatttattgagagacaaatgggcgttactagtgtatttctgggaataccatatgcacaaccacctgtcaatgaagggagatttaaaccaccaagacttcatagaggttggcaaatagtacaggcagttgattatggccctgcttgtccacaacctgcgagatatactggtgtaactactggtgtacgcgatatggatgaagattgtctctatttaaatatttttgcaccaaatataaatgacggagtagcagaaaaatatcccgttatggtttacattcacggaggtgacttcatgcatggagcatcaaattcatttcctggacatattatggcgactttttataaagttgtggtagtgacgtttaactaccgccttggagctttaggatttctttccactggagatataaattctcctggaaattatggcatacttgaccagtgtatggctttgcaatgggtatacgataatgctgataaatttaatggtgatcgagacagcataacattatttggacctggagcaggtgcagcgtcagctggattattaatggtagctcctcaaaccagaaacattgttacaaaagttattgcacaaagtggttcagctgtcgctgattgggctatgatattcgatagatatagagctcaaaataccagtcgagtatttggacaacaaataggttgtagcattgaatcatcatggagattaataaactgtctaagaaactcaagaagcgcgtttgagataggaaatgccgagtttccaccagatgttggattgttcccttgggcaccagtaatagaaatgaatatttccatgcctttctatgaaggatggtatgaaaaagattggcacttcattgatgaaagtgtcgaaaacttaattaaaaaacgcatgtttaacagtggactgagatacatgacgagcttgacattacaggaagctgcatcatttattacttcaaacagaagtttatctcctacatatgagatagatcaaacattttttgatcaaaaagtctgggaattggtgctgcgatataattacaccttgaacgtcaatggaacatttgatgctattaaatatatgtacacatattggcctgatcctaagaatgtcaccatgattagggagaaatacatacaacttctttctgatttcctttataccgcgccaaatgacaaaatgataaagttactagtggaacagaatgttcctgtatatatgtatgtactaaacactaccgtagaatcttttaagttaccagattggcgtaaagtacctcataacattgagcatttccttctatgtggtgcccctttcctagatgtagagatgctacccgccaacgagcgttttaccagaaatcagtggtccaacaacgatagaaacatgagtcattttttcatgaaagcttacactgactttgctagatatggcaacccaacatatactcagatattggggttgcattttgaagaaagtagaaatgctgaattgaaatatttaaatttgaatacaacttataattcatcaattatgtggaactttaggcaaacagagtcggctttttggacaatgtatataccacaagtagtagggcacttggtcccaacttacccccctaccactgaattttggtgggaaccaagagcacctttacaaatagcattttggagtatgtcagctgtatgtttgttacttatagtattgctagtcctctgttgtatgttatggagaaatgcaaagagatcatctgaaggatattacagtcagtattctaaacctccagacactgaaaatgaagaagtagttgagaacacaagaatgactgatgattttgttgaaaaatacatacttccgtcacgtaccaatagtgcatcatcatttcaaacagtatcactgaaagaattacgacaatttgtatcccctagtccgaatggtgagcaacaaaacaatccaagaaggggaactccaatgcttgaacaacgcaatcaggcaaaatcacaaacgaatattctacagggtgttccgcaaaccgacgtttgaatggtggtttttgctaatatagataataaatttaatattaatgttttgtgtatgttttggtgccaaaataatttatcttcagctatttagtagtatttccgagccattgtttgctgataacaaactatacaatatatttttattttagcctacctgttatacagggtatccaaagaaacatgtgcatacttgtaaatatatgtatatacacaatatattgttgtagaatatagaacaatatattgatagaatgagggggtacccttttctttggaccaccattttgtttaatatttttatattattgttaaataaagatcacttttatattgatataaaatatatgtttttagtttaaaaaaaaaa

SEQ ID NO: 115 - DNA, 797 bp, Rhynchophorus ferrugineus
tataggcttaatcaaaccattttttggtcgatttgatctggatatagcccgtttaacaccgcacgacctcaccggaaatctgacgaagcgaaccttggccggcgctgaaataaaagaacactatttcggagaccagcccattccaatcaatccgtcatccaatctgataaagttcgccagcatcgaccaattcaacaggcccatcagggagacagtcaatttactatctcgatacacagacgtttactattaccagttctcccacagaggatccctgggagagttcgaatccgattttcccggcgttggccattacgaggaaatattttatatattcgccaataaagcggacgccaatacggaggacctctatgttcgcagggctattgtggaattttggaccaattttgcgaaatacggaaatcccactccaaagcccactgataatttaacatggatctcgaattctcccaagaaaaaaacaagtgatggagttttttatttgaatgttaactcgacgttaacaattgacaaaaatccggatgaggatgactggattttttaccaggaaatctatcataaatatggagatccccctttctcaacttactagattgatctatatataaagcattttttaaaatgacaaaaacctttaattgaaatgagatataagagatttttttctatttatattttgataataatttaacattaaacaactgtatctaggaaatagatttatatttccgagggtcagtttaaaagacataataaattaatgttacatttatata

SEQ ID NO: 116 - DNA, 305 bp, Rhynchophorus ferrugineus
gagaccccacaattgttcagctataagaaccaaaggcgctttggtggtggttttcagtgttcccgggtacttgccacccaaaacagtatagcgacgatgacgattcaaggaatactgatcggtctcggttgtgtggtggttctgtcttcagcagctagagttaaaaagtttcccagctacgtagagaaatgccaccagagcgacgtggagttctcgacatgcatcctcaaagccatccagctggtcaagccgcacctgaagacgggcattcccgagtttaggctgccgaagatggatccgctggt

SEQ ID NO: 117 - DNA, 1897 bp, Rhynchophorus ferrugineus
atttccacgagttgattctaagattgccagtgtataaaacaaacttgcggtggtctcagtcgtcaattgatgttgctctagttgagtggtgattgtctggtagttttttactcagaatatacctatctcagacatgtcggcaacactgtcaagtcctgaccagatggtccctaccggactctctactcatacttttctctatttgctagtaccagctctagctttattctacacatattggcgaataagcagaaaacatatgctggaactagctgaaagaattccggggccgaaaggttggccgatcattggaaatgctttggaatttgtagggacaccaaatgaaatatttacacgtatatatagacgatcgttcgcatatggtaaaacaatcaaactttgggcaggatccagattaatcatcttcctcaccgatcctgatgatgttgaaattatattaagcagccatgttcacattgacaaatcaccagaatatagattcttcaaaccttggcttggagacggtcttctgatctctactggccagaaatggagagcacaccgaaaactcatagcacctactttccattggaaaccgtaaagaaaatggagaaagaaataggaaaggagttcgactgtcacgattacatgtctgaagccacagtagaaattcttctagaaacggcaatgggtgtcagcaagaaaacacaaggacaaagcggttacgactatgcaatggctgttatgaaactgtgcgagattcttcatcttagacatgccaaaatgtggttcagaccagacatcatcttcaaccttaccaacaccgccaaatatcaaaagaaactaatcaacgtgatccacagtttgactcgtagagttattcaaaagaagaaggccgattttgagaaaggtattcgtggtagtactgccgaacttccggaagaactgaaaaccacaaaacctgaaaggaatgtgtcatcgaaaacaacaaccctcgaaggcacatcatatggccagtctaccggctttgaaagacttgatgatcgaggcatcccagaacggcgtggtcatcaatgacgaggagatcaaagaacaagtggacactataatgttcgagggtcacgacacgacggctgctgggtccagtttcttcctttgtcagatggctgcccatccggatatccaagaacgagttgtgcaagaactagacgagattttccagggttcagacagaccagtcacctttgctgacaccttggaaatgaaatatttagaacgttgtttgttggaaactctaagattattcccaccggtgccaatcattgctcgacaacttcaacaagatgtgaggcttgcgtctgatcccaagctagtattgccagcaggagcaaccattgtcgttgctcaattcaaagttcaccgctcacaagaacaatatgggccaaatgctgatgtctttgatcctgacaactttttaccagaaagagcttctaacagacattactatgctttcattcccttcagtgcaggaccaaggagctgcgttggacgcaaatatgcaatgctcaaactgaaaatcctcctctccactattctgcgcaactacaaaatcaaatcgaactggacagaggacgattacaagttacagggtgatattattcttaagagagctgacggtttcaaaatttcgctggaaagacgcaaaccaatgagtgccaccgcctaaccaaatctaattatcaataatattgattcttgtagaaatgtaaggtaggttaagttgcaatgatgtgagtagagcactattaaatatgtatttgtagtatacctaataaagatcgggttttaatataaaacggtgtcaaagaacaaataaagttccaaaataaaaaaagtg

SEQ ID NO: 118 - DNA, 2157 bp, Rhynchophorus ferrugineus
gttatatgtttgtttttgtcttcatatcgcacgtacaacacaaataattaaactcgtttgaatagactccatccacaacaattattgttatttttgataataattgcccttagaactataaatactgatatacgcagaacaaataatcctactctgtggcagactgccaaagagacgatgttatcatcaaaacttctttcctctatcgattaacaccaatcagctgtgccgggtcactgaatagactctcatgtcatgcgataagtaaacaaagcctttgcgaaaatagaaacaaatttaaaactcgacattcagtgaaattgaaatcatttagaagtgtgaccccggataagccacataattatgttggtgtttgggttattatttacgtcagctttcttcgctgctaatgcagtggatctgcctgtatggaatgacgtttattctgtaaaagctgtgatcgtcatcccctatgctgaaataattgagccattttctgcttggtatgatggccccaacaatcaatcaagaattgattattatggagatatggtcaagacataccaactaggtaaagaaggatacggtaccagtttgaaaatagccccagtgacaaccgaagacgtcaccaactccatcacatgccttcaagtcaatggaactagcgaggagagaattaattctcaaaccgtattacctgatctcactggatttgaatatttgggtgatgagataattgaaggtatcaccacccagaaatggaacttaaccactgttataggtgagaagaaaaataattatatgttatgggtgagacaaaaggcaatagaaggggttcaagtatcgatacctgtgagatttgaaatgagaggctataatgtacttttgggcagtcattatgaccactattatgtacagtataatgaatttgatgtcagcccgatatcagaggaaatattcgaaattccaaccaatatgacgtgtacttcattccctggtcctggtgacaaacacatttacactttcaaccccatggctgaattcatcaagcccgagcgtcagggccacgtcgactttgagttcagtaaattcacacgtaaacacggcaagacatacactaacgtaaaagaagccacccttaggaaggaaatcttcaaacaaaacatcagattcattcattcccataaccgcaaaaacgttggatattccctcgctgtaaaccacttggccgacaaaaccgaagctgaacgcaacgctttgaggggaaaaatttattctggcgaatacaacggcggaaagccattcccgtacaccacagatgatcaagaagaccttcccgatcaatgggactggagattatacggtgccgtaacacctgttaaagatcaatcaatctgtggatcatgctggtcctttggtactgtcggtacaatcgaaggagcatacttcttgaaaaataaaggcaaacttgtccgtttatcccaacaggctttgattgattgttcgtggggatatggaaacaatggttgtgatggtggagaagatttcagagcttaccagtggatgttgaaacatggtggaatcccaactgaagaagagtatggtccgtacctgggacaggacggatactgccacgcggataaagtaacaaaagttgccaagatctctgattgggtcaatgtaactcaaaatgatgagaaggcgctcaggttagctattttcaaacatggacctgtgagtgtggccatcgatgcaagtcaaaaaaccttcagtttctattccaatggagtttattacgatgaaaactgtggcaacactgaagattctctagaccacgcagtcttggctgttggttatggaacaattggtggaaagaactactggctagtaaagaacagttggtctaactattggggcaatgatggttatgtacttatgtcctcagagaaaaacaactgtggtgttatgaccagtcctacatatgttaatttagcttaaattaaaactcttggtgatattatagttacaatgcaaactatatttttattatatacataatcaagatagtttaaataaaaataagtagtacttactctttaattttatttatcacatgtttctgaaggaggagcagttgaagctttcattaattcatat

SEQ ID NO: 119 - DNA, 1819 bp, Rhynchophorus ferrugineus
gtcttacgcaacggagagcgtggtgcagtccacaacatgggcggccacgagtttgttctacatgctgttggtaccagctctggtgttgtggtatgcctactggaggatgtcacggcggcacatgtatgaactagctgagaagctggaggggcccgctggcttgccgctcttgggaaatgccttggaattcactggcggttctgctgatatattcaagaacttgataaccaagagtgcgccgtacgacaaagaggcagtggtgaagatctggatcgggcctcggctgctggtgtttctgtacgagcctcgcgacgtggagctcatcctcagcagccatgtccacattgacaaggcggacgagtaccggttcttcaagccttggcttggcaatggactcctcatcagcacaggtcagaaatggcggtctcatcgcaaactgatcgcgccgacattccacttgaacgttctcaagagtttcatcgatctattcaacgccaactcgagagctgttgtggacaaaatgaagaaagaagccggagtattcgattgccatgattacatgagcgagtgcacggtcgagatattgttagagaccgccatgggtgtcagcaagagcactcaagaccaaagtggattcgaatacgcgatggctgttatgaagatgtgtgacattctgcacttgagacataccaagatctggctgagaccagaaatgatattcaatttcactaaatacgcaaaaagtcagacgaaactgctcgatatcattcacgggttgactaaaaaggtcattaagaggaagaaggaggaattccaatcgggcaaaaagccttccatattaaatgaaactacagaagtgagcaccaatgagcctacagccaaaacaacgtccgtggaaggtttgtcatttggacaatcagctggtcttaaagacgacttggacgtagatgataacgatgttggagaaaagaaacgtctggccttcctggaccttcttctggaaagttctcagagcggtgttgtgatttctgatgaagaaattaaagaacaagttgacactattatgttcgagggtcatgacacaacagcagctggaagcagtttcttcctctctatgatggggatccatcaagatatccaagacaaagtgattgaagaattagaccagattttcggtgattctgaccgtccagccacattccaagacacgctagaaatgaagtatctcgagagatgcctgatggagacgcttaggatgtaccctccagtgcctattattgctcgacatcttaaacaagatgttgttcttccatccaacggaaagaaagtaccagctggtaccacgataattatcgcaacggtaaaactccaccgtcggccggacatttaccccaatcccgacaaatttgaccccgacaacttcctgccagagcgctcagccaaccgccactactatgccttcgtacccttctctgctggtcccaggagctgtgtgggacgtaaatacgccatgttgaaactgaagatcatcctgtccactatcctgaggaacttccgggtacactccgacctcaaggaagaagacttcaaacttcaagcagacattatcctcaagcgagccgaagggttcaaagttcggttgacgccccgcaagaggacgaccaaagcttgctaaacagtttttaggaagcgcactgattatgagctttaagtgttgacggaaactctgtattttcatgaaattcttcgaaaattttagcactttatagcatagatttatgaacactgtatttaaaagtaactatttgatatatagttt

SEQ ID NO: 120 - DNA, 1003 bp, Rhynchophorus ferrugineus
tgttattaggaatatttatttttcttttaaaatatcctatcggtctagagtgaacaatcgaacaggatacctcgtacttttttaattcgcctcatagaaataattttaaacatatcattatctattatagtcgagataagtatacttctcgccaatttagcagtttcgttgctaccaatgtcgtatacgtgatatttcttactgagtcaatagagtgtaatcgacgatccagtgaaataatgttttatcttgtgatttttgcggttcttgtcggcgttttgtggtatttgaagagggcgaatcagtactggaagagacagggaatctaccaggccgaaccggaattgtttttcggaaacagtaggccagtcgtcttgcaaggtaaaccatactgttatgccttactggagagataccagcagtttaaaaaagccaaactgaggtatggaggtatttatctattcacgatcccgacacttattgttatcgatccggccctcattaaacaaatgcttctgaaagacttcaaccatttcatgaacagaggcttgtaccatactccaaaagatgttctctccatgaatctagtgaacatcgaagacgaactatggagaactcttcgcaccaaactcacaccaacgttcacctccggtaaaatgaagatgatgttcgaaacattgctagaaaaaacggtagggctggagagatctttcggggaatacgccgattctaaggaggtctgtccgattagagatatcttggctcgattcacgactgacatcatcggtagttgtgcctttgataccctggtggttgttgggaatgttgaattataaagaagacggcgttgaagtggctaatttcttcagtaacctcgtcaaggacaccattagctacagagaaaaaactggaatggaaaggaaagattttatgcatctcttgctggaacttaagaacaatgcatccggtcaaatactcaccgaaaatgagattatagctcagt

SEQ ID NO: 121 - DNA, 2080 bp, Rhynchophorus ferrugineus
aacgaaagaagagcatgcgaaatttaatgttttgacgtcaaaggcaacaagctatggcctcagatactcgcgaagtatttttacaaccttctattcaacactgagtttaaatgaaaaaaacaataacaatgtaaaccgtgaattgaaatttaattttaaagaagtgacttgtagaagttacaaagaaaattaaacaatgtcagatcatcaagaaccagtgcttttaaatactttcattaatggaaagaaaaaagttaaaattatttttcacaaaggtgttctagtttgggacaacgagagaccgcctttagcacaacatactgtgccaatagaaaatgtcttgtcagtgcaacaaaattatttaaaaagcagtagcccaagtttaaggagacaaatagatccaaatcattttactatacattatgcagaaaaatcaactgatgataaatgggtttataaaagtcttacattgaaacacttagatgcactgcaagtggcttcctgggtgaaaacattacaaaatcatttgttaaagttttctaagagacctaaacatttgctactttttgtaaatccatttggtggtaaaagaaatgctatgcaaatttatgaaaaatatggaaaaggactctttacactagctggtgtggaagtgactgtaaatgtttcccagaggaaagatcagatacgtgactttttaataaaccataatttggatatgtttgactcaatagcatgtgtaggtggtgatggaactgtttcggaattatttaatggattagttttacgagaatgtagattaaaaggtatagatgcaaatgatataaatcaggaattgccaaaacccagaaaaccaattggaattattccaggtggtagtaccgatacaattgcatactgtattcatggtacaacagatcctaccactgcagttttacatataatatttggtgatattttgggtttagacttagtttcagtctatgatgagcataccttgttaaggctatatgcaagtgtattgagctatggatacttaggagatgttgcctatcacagtgaccaatataggtggatgggtccacatcgatatgactattcaggttttaagaaattaattttaaatagaggatacaaaggtgaaattgcgatatatacagatacgaaggaagttcaaggtattgattgcaaaggaaattgtgatgtttgcaaaaatgaaactttacacaaagagaaagcttcgtgcaaatgggaaactttaaaaggaaagttctttatgattagtggtgctaatataagttgtgcatgtagtagaagtcctaaaggtattgccccatattgccatttaggagatggtaaagtcaatttggttttagttaaacatacatcagttgttaataatttgaggttacttttgagactttccagcgctgatgccgttatcgaggacttgccatttgttgagacatatagtgctagggaattttgctttagagcagctgatggtgctgcgagtaaatggaattgcgacggtgaagttcaacatcaaacaaatatacgtgctaaggtacgttgtcagttgctcactatatatagccggggttgccagaaaaacaccggtacaaaaacaaagtgctgtggcttttaaatataaataaggcctttttaaaagtattttttttatatcctttgaagtattatttaaatcttgctcagatataaaaaagagttttgttggatgtgaatgcagaacttgtatatttttttagtcatttctagcattcctatttttataattttaacgtaaattttattgacaatatttattttcttatttttggggaggtccgagttaatttatggaataaggttacattttattttgtaaaattagcatttatatataatgtttttgcaggtgtacttatttgagttgtaagatgaacatataatacagtaacattaaatattattctgctaattatcggtaattgggagtaaatcaataagtattattttgtaatccctgattccagtcaaccacaaattgtgatcatgtgttaataaattttgttttata

SEQ ID NO: 122 - DNA, 322 bp, Rhynchophorus ferrugineus
atggacttctgacaagttctggtaataaatggagaagccgaagaaaagcaattacggcttcttttcacttttcaatccttcaagagtttattcacatatttgaggaagtcggcatgaaactaactaaaaaattgtctgaaatacaaaacaaaaagagcatagatgtgactaacgtggtatcgctttatactttggacgtaatatgcgaggcagccatgggagttcaactaaacgctctggatgacgatacgtccgtttatgtcaaaaacttgaaagatctatgcgctatattagcaagaaaaatattttcacctcttgattc

SEQ ID NO: 123 - DNA, 2386 bp, Rhynchophorus ferrugineus
attaattttaaattataaattagaaaaaaaaaccattttgcataactaacataaaatgcataaacagtatttggtcgtatacatactatctatgaatgattgatagatttgtctcaccctagtcgtaccagtgtgtctgctaacaaattcgtaggaataagatcgatttgttcatagaaaattgttcgattttgctttacgctatcagatcgtttcaccaggctgctactgtgaccgaatttctgaccaaaaactcaaaagacttatagttccttttttcgccttttttctttttccaaaagtaaatttactgtgcctaggtacacatttcagtcagtagaacgaatgaaaaaaatattatttcaagaaaaaaagctattttctattttaatccgaaatcaatttgaattgtaattataatcaatcaattatcaattataaagtgtataaacagtatttggtcatacacagatggaaataaaacgataaaacaataaaataaactgaatatgtagaagttcgcgcagagaaaaggaatcaaaaacgatatattttccatatcaaggaatttatgtgtagttgggttgtaaattaacatttttgccttttctaacatccctagagcactaaacactgacataattcgctctgatttatgtcaacttatcatggcgcattgctatattttctaattatataaaatacatcaccaatctcggcttaaatatgaaagtaaattcatttttatagatcaaccaattcaaacgcattagataatattttttcccttggattttgggtttcctcagtgtcgatgaaccatctctgggtgccactggcaatgccggattgaaagatcaaagcatggcgctgcgttgggtacaaagaaacataaagtactttaacggggatccgaataacgtcacccttttcggagagagcgctggttctgcatcggttcatgcccacatcctttctcccatgtctaagggcctaacgccagagaggttgttgaagcgatgggactcgaagcagcaaccgagacggaagcggtgaacattctccgcactgctcctgtgttggatatattcaaagcacaaaacaaaatacccgatgctctatttcctcaacaacgaagacccttttcggcagtgatcgaagtaccgaatcctgaagcgtttttgtcaattcgatgttatcatacctaagtttgccctaaagtttcttattcctttcgagtcagatgtcaataaagaggaagatatccttgaaataaccagtcaacttcaaccattgtattctccagacccaaatagtcgtcatcatgatgaatttactgatgctaacttcttggtgggcatcctcgaggcggctaggcttcataaactgaccgcgacggttcctttgttcctctacagaatctccatctccaccgagttaaatttcttgaagagaatcatgaagaatcttaatgaaccaggttgttcccatgctgatgacttgggctatctattccgtaccgagttaagtcctgttatcgagccaggaagtgtggaagaacgatccatgagaaatttcgtcactttatggacgaattttgccaaatgcggtcacccaacgccggatgaaagtttgtctgtcgtttggcatccggttgatgacgtagatgatctgaaagtactgaacattgacagagagctcgaattcaagagagtccccgagaaggaaaggtttgaagcttggaggaaaataatggaaaaatggccacgtgtgaaatatcattaaatattccagtaattatgtttgtctctctaaaaaataccacaaggaaccttggacttcataacggtattccattatcagtaaactgaggtcaaaaaagtatttttataagactgtattatgtttttttattattgtgaaatgaattattgaaaataaatgccaaaataaaaaaaatatacaacaaaaattgtggagatattatttattttttaaaataagaaaaatcttcagacattaagagttatattcaataatatttggatctatgtggtcgtttaccagtttggacgcaatatacgaaaaaaggtatcattactaaaaaaccgagtgagcgagagaatgttaatagtaatatataaggtaacatcaaaaggaaataaaatctgtgaacggattattacataaataatttagataatcacaaaaacaaacaacaggttcattacattttcattcggaaggaaggaaatctttgtatccactaaagactttgtaaagacggaaagaatgacaaaagcgatgcctttgtttgtttatcagaagtagaatcaacatcttatagaaataattatctataaaaggatgttttggaataaaatta

SEQ ID NO: 124 - DNA, 653 bp, Rhynchophorus ferrugineus
cctgacttttgaaaagaagaaaattgacaacataaccgtaaagcattacaaacaagtgaaaatttgttgaaagagctttgtcattctaaactattgaatagtaaatattaatccaaaatgagttcaattggtacaggttacgatttatcagcttcccagttttcgcccgatggtagagttttccaagtagaatatgctatgaaagctgtagaaaatagtggtacagtaattggtctaaaaggaaccgatggaatagtattagctgccgaaaaactgatactttcaaagttacatgagcctggaactaatcaaagaatatttaatatagataaacacattggaatggctttttctggtttaatcgcagatgcccgtcaaattgttcaaattgcaaggagagaagctgctgattatagacagcagtatggtgttagtattcctttgaaatacttaaatgatcgtgttagcatgtacatgcatgcttataccttgtacagtgctattcgcccttatggttgtagtgtaatactagcaagttatgaagatggagaaccaactatgtatacaattgatccttcaggagttagctatggatatcatgggtgtgctgctggtaaagctaaacaagcagcaaaaacagaaattgaaaaact

SEQ ID NO: 125 - DNA, 1023 bp, Rhynchophorus ferrugineus
taaaatcaattgttttattctgacatctggtggctacatttgaaactatatgttggcacgtttagatatctgtaatcccaaaattgacataataagtgagaaacgtcaattaaaactgcaagtcgctaaagttacaaagcaaaatagtttttgaggttgtgtttgggcttttgaataagatagtttagtaaaaatgtcttcacggtacgatagagcaattactgtgttctctcccgatgggcatttattgcaggtggagtatgcccaagaagcagttaggaaaggttccactgccgttggtgtaagaggagcaaatactgtagttttgggagttgaaaaaaaatctgtagcaaaattacaagaagagcgtactgttagaaaaatttgtttattggatgaccatgttgtgatggcttttgctggtttaactgcagatgccagaattttgattaatagagcacaaatcgaatgtcagagtcacaagctaacagtggaggatccagttacattggagtatattactagatatattgcaagtctaaaacaaaaatatacccaaagtaatggcaggcggccttttggtatttcctgtttgataggaggatttgattatgatggtgttcctcatttatatcaaacagagccatctggtatttactatgaatggaaagcaaatgctactggcagatcagccaaaacagttagagaattcttagagaaatattatacaccagaagaggtatctacagaacaaggaacaatcaaacttgctatacgtgccttactggaagttgtgcagtctggccaaaagaaccttgaaattgcagtaatgcgacatggagctccaatggaaatgcttgatggagacacaattgaaaaatatgttacagaaatagaaaaagagaaggaagaagaagctgagaaaaagaaggctaaaaaataaggttatagacatataccttttttattgtatttttctggttaagtaattaatttctttataaataagaaaattcaagccaa

SEQ ID NO: 126 - DNA, 253 bp, Rhynchophorus ferrugineus
gaaacttaatggatatgcctattaatggtaacggaaaaatgtggtttaagttagataacttagaaatggtacatgagatcgctctggaggaatacaccaaagatgacaatcaatatttcaagataaaatcctacaatatccaaatgtctataaaaagtgcaagcgtacatttggaaaacttgtttgatggtaataaattgctgggtgacaacttaaataaactcttgaacgaggaatgggagctactttttca

SEQ ID NO: 127 - DNA, 203 bp, Rhynchophorus ferrugineus
gaaacttaatggatatgcctattactggtaacggaaaaatgtggtttaaattagataacttagaaatggtacatgagatcgctctggaggaatacaccaaagatgacaataaatatttcaagataaaatcctacaatatccaaatgtctataaaaagtgcaagcgtacatttggaaaatttgtttgatggtaataaattgctg

SEQ ID NO: 128 - DNA, 1489 bp, Rhynchophorus ferrugineus
ggaacattgatcacgcgttaaaatcacacaagacaaaacaaacaatcgccgtacagctttgcatccgagcgatgatgagcctttgtcagttttttgcatccttttttgttatcgcataagaatatatatgcatctgcattctgatacaacacgcaagtcgtatttgttattgtgacatacctaacccagtgtgtgtgcttttattagtgaatacttggtgtaattgtaaaaaatggcatatggttggatgtttactgtttttgttttaataggggtggataatatacgaggacaggttgatttagacgattatttcaaaaactgtaagcctgataacagcgaaagtttcgacgactgtctcaaagatggcctaaatggactcagagcgtactttaaaactggccttccagattatggcgtcgaaccattcgatcctttcttcgcctccgaagttcatcagaaacgaaggggacccttcttcgactacaaattggtcttgcgtaacgtgacagaatccggatggactaacgcagaagtcacgaaaatcaagacagatccaacaaagaaccaaattcaggtaacgcaaagcttcccagacaagcgcctgaaaggttggtacgaaatcgagggtaccttcctcggtaccaaggtaaagagttcaggaggatggaacctggctctgttcaactacagccaaacgttgactgtatcgaggaaatctagtggcagttttggaaacctgttggacagtacaccgatcaaagtcaaatgtaacctgcacagctgtcaaaaattagaactgcacatcgagaatttggcaggaggaagacgtattattgaaaccgtactggacaggatcatcaacgtggcatggcctcccggcttctacctgctgtctccgctgatcaacgacctggtgggcaccgccttcaccgagattttcacgaaggatttccagtctttccctttcgacagagtgttcggccgttaggatgagaggccccacgcccttgaatcccgcgggaatcgggaccgttcctcgttcaaacaaaggcgtaaaaatagaaccgggagtgtaagcctggcgcttccgttttgattcccgaaaatatccagcgtcggcagggaaccttgattgctatcgagtggagattatgtgtgtttttttttgtctgtttgggtttttcggtatttttaggcgttacggactgttatcgaataatatcctgctataaagtaaccgaagcagcgggcatgacatatttactttgtcaggattgcaccaagttgatatcgccagtatccgccattatttatttaatgttgatttggtggatgaaccttttttatttttatattattaatatttataaatatctgtatataattaaaaaaaatcctttatatcgtatagttatgtaggtatattatgtttaatgtggtttttttcttgcttctagtagagctttccctctctttgatatattca

SEQ ID NO: 129 - DNA, 1290 bp, Rhynchophorus ferrugineus
cacagctgtatttttgacatgtcacaattatacgaaaaagtatgaaaacagaaaagaaatttgagtttgttgtgttgaaaccgtgaacaaattgataactgattacctaataaaaaaggcccattaatttactatggtttttaaaaagagaacttaacagacaatgaagatcgtgactgtagctgcttgtgcttttttctccatgatttttatatccgttattctaggcagttttataagttttataacgaccagtaccgttcatccagatgactatcccaaagaaaaaatatttaaaattgccgataaatttgataacttgatttggttcatacagatctctgatatacatataagtatatttcgagatccatcgcgtattaccgaattcaaagagttttgtgattataccattgatagaataaagccgtcagtggtattggcatcaggagatttaactgatgcaaaaacaaaggattccattggatcacaacagtatgaatcagaatggagacattatagagatattttaaaggaacatgatattggaaataaaactctttggcttgatattagggggaatcatgataattttaatgtaattagtataaattcaaagcataattactttactaattattcaattcagggaagagctcaccctaggtcttatttagttcagaccagaaaaggaaatagtctttattcatttttaggagtcgatgcttgtttggagccaggtccaagaaggccatttaattttgttggtattgtcgatgaatctgaagtgacagaaataaatcagttaataaaaaagattaaggagactgggagcaattatacaatatggtttggtcattttcctacatcgtgtattttatcatcagcaggagagaatgtgagggatttaataaaaaaagatgagaatagtttggtgtatgtttgtggtcatctacacacattagggggtgctgtaaaaaatatgtataccatgcagaaagagggacacttagaacttgagttaggagattggaaagataatagattatataggttgatggccattgaccatggtatgttctcttttattgatatcaagcacagagattggccagtggttcttcttacaaatcctaagcataccctttttataaatcctttaaaagaaaatgttataaatattagagaatcaactcatataagagtattggcatttagtctatcaaggattaaggttgttagaataaggatcaataatgaaccatggactgatttaaagcatattaaggg

SEQ ID NO: 130 - DNA, 902 bp, Rhynchophorus ferrugineus
ggaagaatttaatttataataacacgcaatgtatatgcaaccgaataatcacgattcgaaaagcgtctattttaaaataaatttgacgcgccagattatctctcccccccacggaggcgcgtttttctcggcaatttaccaattgagctgtcctttcgacttaaattgtcatttccgtgttagaaaataaaactggataattcccgaagaggttttcgtgcttagagcgttgagaaatggccagtcatcagacccaaggcatccagcagttgctgacggcggagaaaagggcggccgagaaagtcgcggaggcccgcaaacgtaaagttaagcggatcaagcaggctagggatgaagcccaggcagagatcgaggcttaccgtaatgaaagggaacgtcaatttcgcgagtatgaaacccgtcacatgggctccaaggaagacgtggcagccaaaattgataaagacaccgaggtatatctgagaagcatggacaagttggttgccgataataaagatcaggttatcgacgatttgatcagtctggtggttgatgtgaccccggaagttcacaggaattacttcataatgcgaaacttccacaaaatataggagaacgtccttacagtgtattaacgattgcattttaattaattgtagtttctttttcaactccacaaacattggatttaaaataaatagctgtaccattaaattagtataattttaattaattattcatagttttctacatcatattttcttgttcaaaagttataactagcggacttagctctttgtgacggtcactttacgccaaaaaatatatgggtggtttttattttataattatttaattaagtatgtttggtttcataattattagtttgtaatgtataccct

SEQ ID NO: 131 - DNA, 1400 bp, Rhynchophorus ferrugineus
gtggtgtttttcagcatggtgttctcttttcggttgaaagtaaattaacaataaacaagcgataaattgttttcgtcaggtcttaaaacgatcctaacaattgttcagttgcttttagaaagagtccactttgtttcgttgtgctgttatcgaaacattagtaaaaatgaagttaatttgggttttatgcctgtttatttgtttagaaatcggctttattcacggcgaattacaccctttatcagatgaatttatcgattatataaataaacaacaatcaacatggacggctggaagaaatttcgcaaaagatgtctcgatgaactacgtgaaacgtttaatgggtgttttacctagtttcaagaactttatgcctcctcttttcatccatgatattgagaccgttgccattcccgcgaattttgatgctcgtgatcagtggccgaattgccccacaattcgggaaattagagatcaggggtcgtgtggatcatgttgggcattcggagcagccgaagtgatgtcagaccggatttgtatccactctaaaggcaatgttaactttcgagtgtcatctgacgatctggtctcttgctgttatacttgcgggatgggttgtaatgggggatatcctggcagtgcattcaattattgggtgaggaaagggttggtctcaggaggacgatacaattcacatcagggctgtcggccatacgagatacctccctgtgaacaccacgtaaacggaactagacctccttgtgatagctctgaaaacaatacgcccaaatgtgtaccgcaatgcgagtcaaattataagatatcatataatcaagacaaacattatggactgaaatcatactcggtttcgagcagagtggaacaaatacaaacagagattttcaagaatggccctgttgaaggtgcttttatggtatactcagactttcttctatataaaaaaggagtttacaagcatatttctggaagcttattaggaggacatgctatcaaaattatgggatggggtgtcgaaaataatgtaccgtactggctagttgctaattcgtggaattctgattggggagataacggtaccttcaagatacttcgcggtgaagaccatgtcggaattgaaagtggtatagttgctggattaccgaaattgcagcagtagctgtcatttctgatgataccacatgagtagcttagaatttaatatgtatattatagcatcgctttatatttttgttaatattttcctacgaataatgtaaatcaacaacaactaattctttttattgaataatatgagagagaaaaaacaaaacagaattgtataaaataattgtttaaaatatataaaaatccaattttaatacactgtttactaggttcgc

SEQ ID NO: 132 - DNA, 1206 bp, Rhynchophorus ferrugineus
caaaggacaagaacaaataacggaactattcgtaaactgacgtagcgcagtaatctgaaatattacggtattacgtacccaccgactgcaacgggatgcagtttgaaacgacacagcgactgaaacggtcgtgagcgcaatagcatgttgtttctgtttataagtgtatttttagtgtgcgtttggctttttttgaaatggcgcaactcctactggaatcgccgtggggtcttccaaatagaagccaggcccttgtttagtaaagtgtcttcggcggaaactatgttgaaacaatatgcccgcgccaaaagcctgaaccacaaatacggcggcacatatttcttatacgtacccgtttttattcccatcgatcccattcttatcaagaatatactgcaacgagactttatacacttccatggacacggaacctatcaccaaccgaaagacgtcctctccatgaacctatttaacttggatggagagagctggaaaagattgagagccaaacttacacccacgttcacatccggtaaaatgaaaatgatgtttgacacattattagaaaaaaccacaggtctgaagaaggtggttggtgaatacgcggattctggacaaacctgcgctataaaagatattcttgcgcgattcacaacagacgttataggaagctgtgccttcggaatcgagtgtaactcattggaagaaccgaacaacgattttcggaaatacggcaagaaggcgttcgaacccaacattcgcaaattcttgaaagtgttcctcatccctcactggatattagccaaaaccggttataaattcagcggcgaagacgtgaccgaattcttcaccaacatggtgaaagaaacaatccgttatagagagacgaacaatatatacaggaaagactttatgcaattattattggagataagaaaccaaaaagaaacgacggacagtgtcctgactagtaacgaaataatagcccagtgttacgtgtttttcttggccggtttcgaaacatcctccacagctatcaccttcgctctattggaattaagtcggaacctagatgttcaggaaaaattgagacgcgaaatcttgcaggtgttaaatgagtataacggtacgctctgctatgaagccgttggagatatgaaatatttagacatggtcgtacaagagaccttaaggaaatttccacca

SEQ ID NO: 133 - DNA, 1915 bp, Rhynchophorus ferrugineus
tatcggtattcgcttattaagtatttatctatcatggtcaatgtcacccgcatactaatatacttaaaacccgcttaataaaccagctactctgacggagtcatcagtactatctatatcttgtcattcccttacgtaatataatggtgatattggcctttataatttgcgtccggttatgcgttgatgtaactttttcgcagtcggttattgttgatgttgaaaatggtgctcttaagggagatattagaccattgggagacaacaaggagtattacaattttcaaggaataccttacgcgttacctcccgttggagagttgcgatttcgggaccctgtaccttataaacaatggaatggtaccttagacgcgaccaaagttagaccatcttgccctgaagttcaagtaactagatctatttacactgttataggaaatgagaattgtctatatctaaacgtatttacgtcacagaatcctcaaaaaatagaacaatatttaccggtaatggtttggttctacggaggaagttttagagaaggaaacagtactttatatggtccagagttccttcttaaaaacgaagtcattgtagtaactttgaattatcggctgagtatatttggttttcttgccaccgatgacttgaattcgccaggaaattatggcttaaaagatcaggtggaggccttgagatggattaaaagaaatattcgacggtttggtggagatcctggaaaagtgacgatttttggcgaaagcgctggtgcagcagctgttggttttcttttgatatccaatcagacggaaggcttatttagtggagctataatgcaaagcggaagtccattgtgcaactgggctttggataggaacccaagaaagattgcctttgacttgggtgcagctttcagtatcacgactaacagtacaagaattttgatggatttcttgaggcagaaaaacctcctaaaacatcctaatatattaataaagttatataaagtaaatacacctgattcagttaccaaaggcggacctttaggtccagtaatcgaacccaactatccaggagcattaatcaccaaagacagcttacgtgctttcatggctggcgattttatgaaagttcccattattatgggagtgaatagtcaggaggcaaaatttttagcagcagaactccaatcgtcaaaactgttctatattttattcgacatcagtccgagtctactaatacgtgatcccgtaaatgcaaaatcacctaaagatagaggtctcgctggtcgtcgagttatcgaacattattttaaatccaagtcctttattctgggaagcatgagtgaagttactgagttcttcacagatgacttgttcgtgaggccgataacaaaaaccgctgctttaatgtcaaattttgttcccgtatatttttatgtatatgattatgagggatctttaggaaaatggtggttaaaattcaagtccatttataacccagaaataaaaggagttggacatgctacagatttattttatctctggaatatgacgttaggttccccagagttcaataatgatgaagaacgtctagtttctcaacgactaacaaaactttggaccaacttcgctaaatatagtaatcctacgccagaccccgataagttgcttcagaacatagaatggcctcaatttaataaggaaacaacgagacacttgcacataagttcgagtctgcagatatcccagaattttagaaatcagcattttgaattttgggagaaaatatttaaaaaatattcaaatggtccttatttaatttattaatattttataatattatataataacaaaatataaaatctgtgatagtttagaaataacatttatctttagtatgcacttatttggct

SEQ ID NO: 134 - DNA, 1671 bp, Rhynchophorus ferrugineus
atttagatacgttgacatagtaggacggtcatgatgttgattttggttttgctgggtattatcttggccctcttatggtatctacgtagaaattctacatgggataagcgaggagttcctggtccaaaaccactgccaatcgttgggaatatcctcagacactttttaggccagaaaacacttggacaaatataccgtcaaatatataacaaatatgataaatatccatttgtcggcatctatagagcgacaacgccttgcctactggtgcgagatccagaattcgttcaacgaattttggtgaaagactttaaatcttttcaaaataacgagatgcacgtagagaaagatgtagatgtgttatttggcaggaatcctttcgtgttacgagggaaggaatggagggacacaaggcagatgttatctccaggctatacaagtggacggatgaagaatttgtatcctatgatcactgaaatagcaaagaccatggtgaattttattgaaaaccacccaacaggcacaaccgatggtatcgaaactaggctcttaacgaaacgttttaccctcgacaacgtggctaaagccgctttcggtatagatggcaaatgtttcggaagctatgacgaaatgtccgactttatgcagctaactaatacatttctccaaccaggatctttccaggctatcctgacccaaatgatccaaatatttcctgtcataacaaaattgcctttcatgacttttactaataaatccacggcggataaaatcatatcgataatatcggaagtaaaaaagcatcgattacaaaataacgttcaagcgaatgattatctacagtttctgatcgagcttggaaaagaacacaaattcagtgacgtagatgtgaccgcccacgctagtacattctttttcgatggctatttcacatcttccctagttctgtcttatctgctgctttgtctggccatgtatccagaatatcaggataaagtgcgggatgaaataaaggaaacattggaaaaaaataatggagagataccatatgaatcgctacatgacatgccgtggttgaatgcttgcttatatgagtctactcgtgtgtaccccattgctgaatctatgatgaaagtttgtaccgaagacttcgaatacaccccaacagatcctagttacaaaaacttaaccgtacaactaaagccgggtgatgtggtcatggtcccctatggtattatgagcaaagatccaaaatattttgtagagcctgacaagtttttaccagaaagattgctggagaaagatgaaatgtcaaacaaagtattctttccatttggagctgggcctcgagtttgcataggtcaaaggatgggtatcatgcaaattaagctaggagcagctcatattgtgaagaatttccagatcagtactagtccaaaactatgccaacccattaaatattgcgcatataattttatgaatgaagttaaaggaggaatatggttgagatatagaaaaataaatgatcactaatactaaaaaatatttaatacggatttatataatagtattttctattattgtaatcaacgttatttagttttaaatttaaagttcatgatttactaaatatattagatttttctgtagcaattgaataatttagcactg

SEQ ID NO: 135 - DNA, 959 bp, Rhynchophorus ferrugineus
gtcgacctagcatgtgttattctttatttgtatctggttaagtgttaaacacaagtccgtcgatgacgcagacactcatctgcgcatcgcttctactccaaaacaaaaacaacatccagctgaatatgacataattgtaaccgtctgtgcgtgtattgtttcattattttcagcatccatattactgttttgtttataccagctcgtaagatataactaaggactcaccatgtggtttatttatgttggagtgctatgtttattatcggtatggtactacattaggacttaccgcgtatggtctcgtagaggagtgaaacaaaccataccatggccgttcttcggggattctgggataactgtcttccagctaatgagcgtcccagagatactaaacaaaatttactacatgtatcccaaaaccaggtacaccggattctatcagtttcaggaggcccttttgctactgaaagatcctgaattaataaaacaaatcactattaaggacttcgaccattttaccgatcatcgcactgttggatctagcgatgaaattgatccactgttcaacaaaaatctcttctttttgaaagggcaaacctggaaggatatgagatcattactctctggctcatttaccagtagcaaaatgaaaataatgtacaatttaatagtcgaagcttctgaaaatttcgttgactacttttgtagtaaaaacgaagatttagtcgaagtagaatttaaagacatattcattacgagaacccaaaaatgaattttatgctatgggaaagaaaatgactaatttcaacacttttcgtagcctaattggttttttgttatacatggccgtgccaacaatagctaaactcctgaaaattaaaatattagcgaaagacgcttcggatttttttataaacatcatagaccaagccattagaatgagagaagaaaatcat

SEQ ID NO: 136 - DNA, 914 bp, Rhynchophorus ferrugineus
gaagagagcgtttttcgaatattttgtcgaaagatgcttacgatagactttttccagtccttccgattgttttcgtactttttcgtaccgaagttcgtgtacttgtttaagctgaagctcttggacaccagctattttcgacagatatttttggaaacgttatcagaacgagagaaaagcggcgtgaagaggaacgacctggttgatctgttgattcacgtgagggatatgttcagcgatgagaataagaatggcactcagtttgatactacgtgtatggtagcacaagcaattactttctttacggccggctttgaaaccaatttttgaagcgttctctgacgatgactcgcatataagtttcgaaaaactgcaacaattaaaatatctggatatggttttagcagaaacattgaggcggtatccgtttggtcccttcctcaacaggaactgtaaagctgattatattatcgaagaaaccggtctaaagatcgagaaaggcacccctatattgatacccattgatggtttacattttgatccccattactatacggatccagaaaaattcgatcctggacgttttgaggatggtgttaagggttacaccaattcctgtgtctatatgccttttggctcagggccaaggaattgcattggtgatcgatttggacagatatcggccaaggttggtttggtccactttttgaaaaaatacaaggtggaaaaatgccatttaacccaagatcccttggtgttggacgcgaagtcaccgttcatgactccagtgaatggattacaccttcgaatagaaactatttaatttatttattaaattattgttgcacaaatatttttagattgtatgcttagagtagaaggtaaaatagtcaaatatatgaactaaaattaca

SEQ ID NO: 137 - DNA, 430 bp, Rhynchophorus ferrugineus
catggacatggttgtgtctgaaattttaaggaaatggccgcctgttataggcactgatcgtgtttgtacaaaaccatgcaccatatcgagccagttacctaacgaaccactactcaacattgaaaaagaagtgatggtatctattccggtattgggactgcatagagatcccgcttattaccccaatccagagatatttgatcccgaacgcttcaatggagagaacacaattgaagagtttgcttatattccatttggttgcggtccaaggaagtgtatagcatccaggtttgctttggtggaattgaagtctttgttgtttaagtttcttttaaaatttgagattttacctggcaagaaattgcagttacctataaaattggatcaagcgtcatttaatccactaataaaaggaggattttggtttatt

SEQ ID NO: 138 - DNA, 221 bp, Rhynchophorus ferrugineus
aaggtatcaagcaagaagataataccgatacgattgatgctggttttgctacagttcaggaatcaactgatataactaaattccgccagcttaaacaattaacaaatgacgatataacgtctcaagctttgatctttttcttcgctggatttgatgcgatatcaacagctatgtgttttgcatcttacgaattggccatgaataaagatgttcaggataga

SEQ ID NO: 139 - DNA, 235 bp, Rhynchophorus ferrugineus
attagaatgagagaagaaaatcatatcgttagaaaagatatgatcaatataatgcttgaagaaagagaaggaaaagctaggcaagatgacgaggaggttatagattcaggatttgctgttgtggaagaatctcagcatatcacaaaacatcctaaaaagcagatgaatctaaccaacttggatattacagctcatgccatgatatttttcctagctggttttgatactgtgtcta

SEQ ID NO: 140 - DNA, 866 bp, Rhynchophorus ferrugineus
tgttgaattatctctagttcgtcataatatttaataagaaaaatatacctgtatatttatttctgagcattaccaaaaatttgactgttacttatctaagagataatttagcagattatttgagctttaaaatgaggttacatttttgacagaatagaagttcaagaaaaattaaacgaatccggatatatattataatattataagctaacatgttagttttagtgttaggtgatttgcacattcctcatagatgtagtagtttacctgccaagtttaaaaaactcctacttcctggcagaatacaacatatattatgcaccgggaatttatgtacaaaggaatcgtatgattatttaaaaacattagcatctgatgttcatgttgttcgaggagattttgatgataatttaagttacccagagcagaaagttgtaactgttggtcaatttagaataggattatgtcatggacatcaagttgtgccatggggagatccggaagctctcgctctaattcaaagacaattggatgtagatatattaatatctggtcatacacataaatttgaagcatatgaacatgaaaacaaattttatattaatcccggaagtgcaacaggcagttataatgctctagatacgtcagtaacatcatcatttgtattgatggacattcaaaatacaactgtcgtaacatatgtatatcagttgattgcagatgatgtcaaagtggaaagaatagaatacaagaaaaattaaatctaagggtatatgttaaatttatgtttatttttaatttgttattgtattaagtattattttatatttacatatatgttaaaggttatatacatagatccacac

SEQ ID NO: 141 - DNA, 374 bp, Rhynchophorus ferrugineus
cataggtttgcagttagtgtgttaactaacgttcggtactcttactgctgttgttcaagtattttacaaataaaaagaaacatgatgaactggaaaaatatagctttttacactgtacaatttgaaataacaatcttactgtccgtagtaatattctttgtagcgctatatggaaataccttttgttggagctgcatacaattttatggttagacctgaatacatttacagtatattcacaaaattacaagaaaaatatcctgatggaggaaaattttggtttggatcgaaactagtctattttctacataaaccggaacatatagggaagattcttggaagtcacaaattagtaaaaaaggatgaactctata

SEQ ID NO: 142 - DNA, 2642 bp, Rhynchophorus ferrugineus
caagctttctgtgccgagtttgagtcgcgaccctcagtcagaatcagcctgtcatcaaacgaacgtcttcgtgcggacgctcgagcccacaccacgccgacgcgatcgctttttcaccgtttaccctaccgcttcggtctcagagcaacagatatttatccacgtgttcgttcgatatgctctcttaaactccggataggaaatgtcgatgaataaaatggagttctcgttcgtgttctgtctgatcggtttcggtgccgtgatgtcggtgtgcggatattcgtggcccagcgaggaaaccaccaccaggtcgcataaagacgttcacagcgatcctctggtagtggagaccaccagcgggatggtacgcggttattctaaaacggtgctgggcagggaagtgcacgttttcaccgggatcccctttgccaagccgcccatcgagcaactgagattcagacgtcccgttcctattgatccatggcacggggtcttgaacgccaccaaattgcccgattcctgtttccaggaacggtacgagtacttccccggtttcgagggcgaagaaatgtggaaccccaacactaatatatccgaggattgtttatatttaaatatttgggttcctcagcgcttgcgcatcagacaccattcggataaaccaccaatcgaacgacctaaggtacctgtactaatctggatctatggcggaggctatatgagtggaacagcaactctggatatctatgatgccgacattatagcatcaaccagtgacgttatcgttgcctcgatgcagtaccgagttggttctttcggattcctttatttaaacaaatatttccccaaaggtagtgaggaagcacctggtaatatgggattgtgggatcaagctctggcaattcgctggattaaggagaacgcagctgcttttggcggtgatcccgaactgattactctttttggagaatccgctggcggtggttcagttagcatccacttactcagtcctataaccagaggcctcgcaaagcgaggcatattgcaatcgggtacaatgaacgcaccttggagctacatgtctggcgaacgagcagaacaaatcggacgggtcttagtacaagactgtggatgcaacgtcactcttctcgagaccaatccttacgaagttctcgattgtatgagagccgtagacgcaaaaaccatctccctgcagcaatggaactcttactcgggcattttgggtttcccatcaacacccaccatagaaggaacctttctaccgaagcacccaatggatatgctggcggaaggcgactacgaagacatggaaatccttctgggaagcaaccaagatgaaggaacatattttctgctctacgacttcatcgatttctttgaaaaagatggacccagttttcttcaacgagacaaatatcacgatattatcgacacaattttcaagaatttcagccaattagagagggatgctattgttttccagtatacgaactgggaacacgtgaacgatggatatttaaatcagaaaatggttggaaacgtggtaggagattatttcttcatttgcccaatgaacgatttcgcagaactagcggccgagagaggaatgaaagtttactattattacttcacgcacagaaccagtacgtcgctctggggcgaatggatgggcgtgatgcacggggacgaaattgaatacgtattcggtcatcccttaaacatgtctttacaatttaactcgagagaacgtgatctcagtttgaggatgatgcaggcctttgccaggttcgcagctacaggaaaaccagtaacggatgacgtcaactggcccttgtacacgaaagaacagccgcaatattttatattcaatgccgataagaatggaatcggtcggggaccgcgtgcacaagcctgtgcattttggaataactttttgccaaaattaagagaaaattcaggttctgaagatctaccgtgcgtcaacacgtacctaagcaaaataggttcgtcatcgggccgtctccatccgccagtgaaaaacatgctcgaaatcatcatattcatattggttctttgcgcaatataagccgccaccaagctacgttcgcgcattcaaaaacctagtcacacaaaatttagatctacgccactgtagaggccctaagagctcaggctgcaaaattggtagactagagtgatttttagatacgtagccaaaacaaaaataaaaacatagataagctgttttttcgtagaagtttttgtaggccattttggagatctatgcggttttgtagtggggccaagattggcaccgggaagctcgggaatcattgagatgaaacttaaaaatgacttttactacgtaatttttatattgacgatacatttttgaagagaattttaaggaattttggcatattattgataaaaagacaacaaaccaaagcgcggaacatttacccgctttctttggtgataataatttagagaatgaaaagaatatataggttagaacgaataagaattaaatatactatgtgtaatatcagtaggcatacttttgctgctatgtttgatgtgctttattcaacaaaaaaaattatatgtcattgaatgtg

SEQ ID NO: 143 - DNA, 221 bp, Rhynchophorus ferrugineus
aaggtatcaagcaagaagataatagcgatacgattgatgctggtttcgctacagttcaggaatcaactgatataacaaaattccgccagcttaaacaattaacaaatgatgatataacatctcaagctttgatcttttttttcgctggttttgatgccatatcaacagctatgtgttttgcatcttacgaattggctatgaataaagatgttcaggataga

SEQ ID NO: 144 - DNA, 1550 bp, Rhynchophorus ferrugineus
gtatattaaagaattatctgatatatttataatataaagtcggcctttctagtcagtttagatctagaaacaattacagtactatgtcgacgctgtggctcctcgtcgggttggtcttcctatctatattgtggatctcgatgtcgctctaccgcaaaagacgtttgtttcgattcgcgaggaacttcaacggtccccgattttatccagttctagggaacgcgcatcacgttcttggaaaagatttattccaagccattgaacatatatccaagaaatatgggtttccttgtaatctatggatagggcatcattatcattatgtcacagcggatgctgatgatgtgcgtgtcatcttgaatagtccttattctctcaataaaatgtccatctacaacattatgggattgctgatggctgatacgttgctacttttaccagctgaagaatggaaattgcaaaggaagtttttctccaagagcttcagtcaaccgatcctcaacagtttcgtgggggtgttctacaagaaaacttcaagtctgctgaatattataaaagaagcagaggaagttgatgtttttgacgtatttgaacaatatactattgatgcattctgtgaaactataataggtctggattacgatatgcagaacaatccgcaaatcaagattgccgagtggctaggagatattcagacgatttccggtaaatacatggtatctggattattacacccggatatgatgatcatattgacagccgaaggaagaaaagtcattcaacgaatagagtatgcggataaaaatgccctacctctgctggacgccatgctacatgccaaagaaggtcgttttaacgatgagaaaattaatcaagaactaattctatttgcattagcagcaactgatacttcaggttatacactagcttacgtttttaccttgttaggtatgcatccagacatacaggaaaaagtatacgacgaagttatttcagtagtaggtcgtgacagaccaatatataacgaagatctgccgaatttgaaatacgtggaaagatgtatactggaatcgatgaggatattaccggtcacgccgtttattggtcgtatggctatggctgacctgacagtcggtagtaaaatcatacccaaaggaacaaacctgtttgttagtatgtttgatttgcatcgaaatgaaaaatactggccagaaccgctgaaatacaatcccgaccgatttctgcctgaagaagtagcgaaacgagatccctacgccttcattccattttctgctggacccagaaactgcatcggaaaaacatatgccatgatgttgatgaagacagtgattgccagtgtgataagaaactacaaggtcttctccaattatcaatcagttacagaactgaaattctcgtcttgcatcaccatgaagaccaggcaccatctcgattgtagatttaagcctagatcaccaccgtagtagcattgtatattgtaaattgcttttatgaagagggatatttaataataaagatatttaatggaa

SEQ ID NO: 145 - DNA, 695 bp, Rhynchophorus ferrugineus
ctttgctttaactaacaatgttctacgcaatatattaaaatttagttggccagtcttgaacatgacagattatactaatcctgaaagaaactttatcgtttacgatatttactggccttcattcaactttactggtgactataaaatagaatataaaacgccatcgtcagagggtaaaaaatttaatgggtcctataatattctattgaatcatattaactggtctggagatgtagattttatacaaccttgtcaaaatataaaaatgcaagtagacaagttcagtcttaaatctaaagttaaagatgtgaaggtgaaacttactggaccccttggagatgatattgtcacattgattctcaaaaaagggatttaccttctgttcaacaatatcccaagttttgtggctgatcttttaagagagaaaaggttgaatgggttctgggcaagtcatccggaaagaattgacacagtctttcagttctgtttaaataataaatgatttaataatcatctatagtaatatagatataattctcttacatgcaacataattattgttctaattaaatagataaaaatattacttgaaaaaaaattttatttaaaaaatggttactagtagaataattctaatcatttttaaaataactatggacaatttgatttatatttaatatagttgctaaaagaac

SEQ ID NO: 146 - DNA, 1817 bp, Rhynchophorus ferrugineus
ctgatattatgctctgtttaacgttggatgaaagaaaatcaattatgtgaatgaagttagtttaggaagtaaacacattattttaaactagcacctaagggcatttatttaggcaattgttctttgcattcggcaatgggattcgcggaatcagctacgtcaccttcttctaacgtttaaaagaagtaaatgtctttagctgtgatttagtatcttcttgttggtccatgagtgatactcgctgactatcgtagattttgcgacaaataacgcgcgcaagttcgagtttatttcattaaaacttattgacaaatctactgccacaacatgcggatacccttgattcttgcggcgttgtgtgccttgacggcctgtgacggtccaagacattccaaaaaagtgtttgtcacccagacacatgcctcagtaccactcctcgctctgccacatgttagtgccaccgctaatgtgggtattggtccccatattcaccctaccattaaatttggccacagcacccagcaaatccatcatgcacattttgatgtgcatactattcagcagccgtcctatattcacaccgagttcaagaaactggtacccatcagtttagagaacttgatcgaggaggaatggaaagctttcaagttaacgtacaacaaagaatatccaactgaagaaatcgaacggtttcgtcgggaagttttcattgaaaacagagcgaaaattgccagattcaatcaggagtacagcaaaggaaaaaccaactacgtccaacagctaaatccctatggagacttactgaatcatgaattcaaccagttgttaaacggttttcgaagattctccaatttgacggctcagaagattccggtaccatccacctttattcctagcgccaatgtcgcaattcccaccagcgtagattggagacaagtaggtgccgtcactgacgtcaaatcacaaggaaactgcctaagttgctgggcatttgctgccgctggagctttggaagctcactggttccgaaaaaccggccaactagtggacatcagtgaacaaaatttggtagattgcaccagagattatgacaacgatggttgtatgggtggtcttattgatccagctttccaatatatcagggccaatgacggcgttgatggcgaagaagtatatccatatgaggctaaagatggccaatgtcgatttaggagagaaggtgttgtagcaaaatgcacaggttatgttaacatcgctgaagccgacgagaaaggattagaaatagccgtatccactttgggcccagtagcagccgctatcgatgctagcagagaaggtttccaattttattctgatggcatctactacgatccagagtgcggaaatggacaagacgacgtcaaccacgcagtgctcattgtcggttttggacaggaacccaatggacagaaatactggctggtaaagaattcttacggatcgcaatggggcataggtggctatatcaaaatggcgaaagacgcaaacaaccactgtggaatcgccaaccaagcgacatatcccctagtttaacagtattattttttaagaatttatttgaaattaatgtaaaattaaaaacgaaaattttttgtgtttcctttgtgccacaaaagcataatttaatatgtaataattaaaaaatattgtcatatgctgcataagttatttttcctcgaatacattttgaataaacaatttttatatgtatatgagtcagatattattcaaaccagattactctaatcgaatgtagaacatttatatgttgagcaact

SEQ ID NO: 147 - DNA, 1809 bp, Rhynchophorus ferrugineus
gtccgtgcctttgactgaaatagtaattaccattttccgttgactatttctttacgctcgacagttttgcgactatcgactattttcagtcgataattcccaacgctacatataacctaaaatattgtgttggtgtttatattgttttggttactatattattttgaaatattaaaaaaaatgaagatagccgtagaaggatgtgctcatggtgaattagaacgaatttattgcacaatacaagaaattgaacaaaatgaagatataaaaatcgatttacttatatgttgtggtgacttccagtccaccaggaatgaagatgatctgtgttgtatggctgtgccaccaaagtatcgtcgcatttgtagtttttacaaatactataatggagaaaagatagctcctgtactgacaattttcattggtgggaatcacgaagcttcaaattatttacaagaattaccttatggtggatgggttgctcctaatattttttatttaggttatgctggtgttattaatattgctggtataagaattggtggactttctggaatatataaagctaatgattatttaaaagggaggtttgaaaaaacaccgtatactgacagtactataagaagtgtttatcatattagaaatttagatgtattccgtttaaagcaaatgtctcaaccaatagatatatttttgtctcatgattggccggcaggagtttataattatggaaatatggaacaattattaaagagaaaacctttttttaaagatgatatagagtcagataaacttggaagcaaaccatgtcaggatcttcttcactatcttaaaccacaattttggttttctgctcatttgcactgtaaatttgcagcattagtgccacatgatgataatacaatcaccaaatttctgtctttggataagtgtttgcctagaagacattttttgcaaattgttaatattgatcacaatgagaatgagaaaattcagattaattatgatttagaatggctaacaattttaagtttaacaaatcatttaataaatattaaaaatgctataacatatatgccaggtccaggtaatttagaaagatatgattttactccaactgaagatgagaagactttaatatttcaaaaactaggcgaatctcttaaagtaccaaacaactttaaacctacagctcttggttacaataacacaagtaaaactaattctaaacaaccgcctgctaaattaaatccccaaacagttgaactgtgtaatttaatcggattagatgatcctctaagacttgtttctgaaagtaatggcttaagtttaagcctggattctagctttttagatagcacatttataactgatccttcagattcatcagattctgccagtgaatcgaaagtggaatcagatatatctctacaagaaaaaattaaggagttgaaattgcccgaacccaaacatgagataaacaatgtgaatatgataaatactgcagaaagtgatggtttaaaaattgaaacatccatacctataaaattgtctcctaaacggtctttagatggagaagttagagaaaatgaagaagtaacaaaaccagaagtaaacaatggaaacccttccccaaagaaatttaagagaagaaatgctcagatttactccactgagagtcatgatagctgacaaaaatattttatttgtaaattgttttgaatcactttttttgcaatactaataataattttaggagtcatatatggttacattgagtaacatcattcctttcgttatcattgcaaa

SEQ ID NO: 148 - DNA, 1181 bp, Rhynchophorus ferrugineus
agccatcgtaatattctacatttatcgtacatcacaagtattgaccacttccttgtggcacacctgcttttgcttcttttaatgtaagacttagggtctacggataatcttcaaggtacagattgacagaagtagtttgtgttccgtacacaacagagtgaggatgaagtcgctgttgatttttgttttgggatttctgggatgcggtttggttgatgccaatataccttcttacatcaaactatgtaaaaggaccgacccaaacgtttcgcaatgcttgcgggagtccatcgagtacctccgacctaaactgaaagaaggcatccccgaactgaacgtaccttccctagaaccactacctctcaacgagatccgactgaacagtggcccgaatcaagcgaggatcaacgccaacatcagcaatctactggtacacggtcctacgacgtttaaaatcaacgatttgaaggctgacttgaagaggacgcgttttttgactcagttcaccattccgacgctgtattttgaaggcaactacgaactggatatgaatgtactctttattaaatatcaaggaaaaggtccaatcaatggaacttttactaattacgtgttcaactgcttaatgaaggcggataaggtagaacgaaataacaaaacgtatctgcattttcgcaagttcacgttgacgctacagactgggaagagccagctattcctggggaatcttttcagcgacaatggtgaggtcctagctcgagcctcccaggatttgatcgagcaaaacaccgatgtgctgatagacgagatcaagccgactctggagcaaggcttggccgagaaatttacgaaaatcgcgaacagcatcatggatcgatatccatacgacgaactgttccctcagtaaatattcatataaaaatgttctatgtagtcaataataaataattttatatagaaaagaaaaaaatgacattgtatgcattcaaggatgacttaaccaacgagagaacaaaaacaaataaactgtttacataatttttttttaattaacagcttcccatggttcattttattcgtgtttttctattgtcatgcaattaaaacctgctaattatcatcagacaacatttcggtagctatatggtcacttaaataactcatttcgaacaaagacgtgg

SEQ ID NO: 149 - DNA, 2562 bp, Rhynchophorus ferrugineus
cctgtttaagtaatcctcactcatagatagatatgtttggggttcaaataattgatgcaaaacgagcaattaacaatgaagttttgatgtaaatcgtgcgatgttgccaagccttgcacttcgtcctaaaatttcagaaaacaccgtacatgtgtcgttctcaattttagttttctttgaaagttatactgaaaaataaaacaatttaaccaattaatgttttttgccatcatagccataactatcactatcaattaacaaagatgatcgatcatcaatcaattcacgcaaaacacatgaaccattgacaatcaaactttcatataaattatacactgttgccacgtcttccttattttactaaaactccagaaaagtgaacatcaagctgtgctggtttatttgaaataagttatagcaaacatgctggaatatacggaggatattcaccctgatgatcctatagtaaccttccgagaaggtaaagcagctggtttaataagcgaagatgctaggggtggaagattctatagttttctgggaataccctatggaaaacctcctgtagggaatttaagatttagagtaagatttagagcaccagtagctgttgatccatggaccgggatatttaacgccaaaaattcgattaacccatgcgttcaggagaatcctctgacgaaagtaatggatggggttgaggactgtttgaatttaaatgtgtacactcccggattacccctacagacctcgaagccgaaacatcaactaaagccggttatggtcttcatacatggaggcagtttcctctctggatcaaatgccagggagatgagcggtccggaactgctcgtggcggaggacgtggttgttgtatccatcaactacagattaggaatcttcggattcctgagcttgaaggatccgaaactggacgttccgggaaacgctgccttcaaggatatggtgttggcattgaggtgggtacagaggaacatcaccagcttcatgggcgatccaggaaacgtcacgatattcgggaacagcgctggggccgcggctgtgcatcttctagtgctttcgcccatggctaaaggtctatttcacaaggcagtgtgccaaagcggctcggcattgagcagctgggcgtatggcgtgaacaatgccaaactgatggctattgctatgggtttagagtcaacaaacgaagccgatattctaaaacacttggtcgaagctcctgtggaggacatcttcaatgctcaatgcaaaattgatagcgaaacgatcaaagggaatcgatttcgttttattggagctgtcgtcgaacccagttcctggaagggcgagaaattcttctccactcacccggtgaaaatattagaatccggcaaatacaacaaagtccctctgctgatgggttacaactctgccgatggtaaggtatgatcgtcgacgggatggtaccaccggaactaaattacgtctactggaccgacaaagagttcaacgtgcccggtttactgcgactgaagaagggtagcaacctgtcgaaacaacttggtgaagaaatcatacggttttatttcggtacagggaatatatcgagggatacccatctacaagaattttacaacataaccaccgataattctgcatcgaaaaacctcaaaaatgccgatttatttctatcgaatgtccatcgaatcggacttgaatttctacaagaaaatgttgggaattgaacttccaggcgcctgtcacgctgacgaattgggatatctctttaggactctgttaactgaaccccccacgcctggcagtatagaggatttggcccagaggcgaatggtacgcctgtggaccaacttcgccaagtacagcaatcctaccccgtgtcaggatccgttattggacgtgatgtggcctccggtagatcgtaacaccgataagattgtcttcttagacattggggagaagttagtggtggactgcaatcccgaacacgaccggatgaaattttgggataagatctatgccaggggaactctatcttccaaattgtgaacccacaacgaaagtatttcaacaaaatgtgatataattattgattaatagatgattcattcataataatcgaacctttaaaattaattttctaattttttaaataatgttcaaaaaatatcgatataatttgaaaaaatttcaatatatcgatatttgttcggcatccctggcacaaatcaatccaacgaccaaaaaaaagaagaagaattgacgtattgaacacaatgacaagtgaaaagcagtaactctgcaagtaattttgtcatatcaggcaaaaaaagaaaggaatgtaaaaaatacgaactattaatgcatataacgaatttggcttggacaacatttattaaattaaccaagatctttggttaatcgcaaattatcttaacatcatttgtgtcaaaactgtcgattttgacagtatacacttgtttgattcatcaataaaataaggttaaaacgttcttcctaaagtttttaacttttatcaagtta

SEQ ID NO: 150 - DNA, 235 bp, Rhynchophorus ferrugineus
attagaatgagagaagaaaatcatgtcgttagaaaagatatgatcaatataatgcttgaagaaagagaaggaaaagctaggcaagatgacgaagaggttatagattcaggatttgctgttgtggaagaatctcagaatatcacaaaacatcctaaaaaacagatgaatctaaccaacttggatattacagctcatgccatgatatttttcttagctggttttgatactgtgtcta

SEQ ID NO: 151 - DNA, 275 bp, Rhynchophorus ferrugineus
catatggacccggaatactaccccaatccagaagtattcaatccagagcattttagtgaagaaaacaaagcttccaggcctgatttcactttcctaccgtttggcgaaggaccaagaatgtgtatagggctgagattcggtaaactgcaaaccaaggtgggattaataagtctgatcagaaaatataactttactttgaatgagaaaaccaaaattccactggagatggcaccaagcgagattgttatggcgctgaaagacgacgtatgggtaaa

SEQ ID NO: 152 - DNA, 1741 bp, Rhynchophorus ferrugineus
gtcttcgaatagcgcgcggctggaaaggtccgtgtgacgtttctctattcgatcgctcattcggagcctagcgctgtacgtcggaatacgtcctacggtattccgcgacaagttcagttttgttattgtttttatttacatttagatgcgagtgtgattcgttgtcagttcagtgtgttatcagataatagtcgattatgcttacattttggatacccacgttatggattgtttgcgctattttacgaataggagcttctcctattggttttcaatcgacatatgacaacaacccaacggtggtgataactgccgaagacgaatttagagacgagtgggactataaaacgcaaagtagcaagatgccgctacttgcatcgatactgagaaatcacagtttaccatcgtcggcggaatctactggtagattcctctttggccgcgaccaagaaaaatcgtcgcacctgccaccgttcgtcgacaaagcccttcgcctcctcaacctgaagcaggtcgcgttcgagatcgagaactcggtcatgacgaaggtttcgtgcactgcatgcagagcgggcgctggtcttttgcagcactacacgaaaaccggcaaatccgaaaaggagatcaagaagacgatttaccagttctgcgtcaacctgaagattcagtcgtcgagagtttgcgagggcatcaccgaattattcgccagtgaggtcatccatgtcttgggcaaagttaatatcggacctgatgagatttgtagttttgttatcggtgatgcttgcggtgatgtttacaatccctatcacgaatgggaagttgctttccctccagtaccaaaaccaacaccaaccgaacaagaaatcccagagcaaagtgcacctactttcaaagtgctacatctttccgacactcactatgatccttattacatggaaggggctaacgctgactgttctgaacctctctgttgtaggttaactaatgggccagcttcgtcgaaagaatcagcagctggaaaatggggcgattatagaaaatgtgatacgccaaaaatcaccgttgacaatatgttgcagcatatccaggacacacacccagacatcgattatattatctggactggtgatttaccaccacacgatatttggaatcaaactagagatgaaaacctgaagatattaaaggaaaccgtgaaacaaatgtcggaaatgtttcctggtgtacctattttccccgcgttaggcaatcacgaggcagccccagtcaatagttttcctcctccgtttgtaaacacaccggatagttcaatatcctggctatacgatgaattagatactcagtggaggaaatggttaccaagttcagtcagtaaaactgtcagaagaggagcattttattctgttctagtcagaccagggttcaggctaatttctttaaacatgaattattgcaacaacaagaactggtggcttcttttaaacagtaccgatcctgcaactgaactgcagtggtttatttacgaattacaatctgccgagtttaacggcgaaaaagtacatgtcatcggtcacattccaccagggcattccgattgtctgaaagtgtggtcaaggaattattattccattataagtagatatgaatcaactataatcgctcaatttttcggtcacactcattacgatgaattcgaagttttttatgatcacaaggatttaagtagaccaattaatgtggc

SEQ ID NO: 153 - DNA, 443 bp, Rhynchophorus ferrugineus
gcgatgtgaaatatatgatttttatcgagatatagcaaaaatgtacaacaccagtatatatattctactcgctggattcctggcaaaccaagcctattgtagtccattcaaattctgtaaagaatctgaagcaaattttgacagttgcttgacagatgctattcaatatgccattgacgctctgaaatcagatgtaaatgaatatggattacataatctaaaaatgattaaggttgattcaatgtcgattgaagaaggtgctggagttgtcaagtttcaacaaaactacaagaatttggaacttacaggaatagcagacgctacagtaaaaaatgcacactatgacaaagcaaataaagttctctcgtttacaattcaaataccaaaatttggacaaagagctgattacataatcaagggaaacttaatggatatgcctatta

SEQ ID NO: 154 - DNA, 210 bp, Rhynchophorus ferrugineus
ctattattatctattcagtcacaggggatccgcgagcttcacggaaatttttggaggtggggaagaagattacggtgtttgccatgctgatgatctgcaatatcttttccctgttggagatggcttatttcctgaaagaacccccagcgaatctgataaaagagtggccaaaatatttaccactttatttgccaatttcgcctacactgg

SEQ ID NO: 155 - DNA, 2120 bp, Rhynchophorus ferrugineus
tgttgcgatacgcagaataaaaatgcggagaagaaataaaaataggtgcatgtaataaatttgtgcggtgttgttaatggcaaggaacgataatatcggttgttgagatcattcactaaagcaaagcgcgctctcaagctggtttttgttggctcagtagtcatttgaacttgaatagaactgtattgtgggtagaagtggttccggcgccatatagcgtgtttattgcagtaacaatgatagccaggtggataatagcaagctgtagcatactactcggtttgctgacattcggatcatcgcaaatcatcgataattttgaggatattcagggcccctattgttcagatattgggtgttgtttaaatagaacagatagttgctccaaacccattataggaacattatgctattgcgatgagttttgcgatcggcatttcaatcaggattgttgccccgatttttgggccgtgtgcaaaggcatcacaactacaacgaagaaacctttcactacgacaaggccaccactaccgccagaaccagaaacactgtattcctgcgaccataatggtgtgcggtatcctattgacaccgaaattgtagacaactgtaacacttgtaaatgtgaattatcgggcaatgacgctatatttcgatgtgagcaaaatatctgtttgatctctccagaaatcattagcgatgttaatctgaataaccgccaaacttggactgcatctaattattctgaattttggggcagaacgcttgccgatggagtacgttatagattaggaacaacaaagccacacaaacaggtgatgttaatgaattcggtaaagcgctactacgatccacaccttttaccaatacaatttgacagcgccacgaactggccccgtttcatttttggcataagagaccagggctggtgcggatcgtcctgggcgatctctactgctgccgtagcttcagatcggtttggcattatgtcagaaggctttgagagcgtgaatctaagtccacaaaatattatttcgtgcgctagaggatcgattccttgcgaggctggacctttggatcgtgcttggaactatgttagaaaatatggtgtggtggacgaagattgtttctcctataccggctcgtcagaatccaaatgtcctattaaaaggacgaccacactgtcgagtgctaactgcatccctccaaaatacagcaaccgaacagaattgtacaaagttggtcctgcatacagattaggaaacgaaacagatataatgtatgatattataagatctggtccagttcaagcgactatgctggtttaccacgatttcttttcttattcccgcggtatttatcgtcatactgatctatctctgtcgcacctgaaaggatatcactctgttaggattgtcggatggggagaagaaaagacacgcttcggattacaaaaatactggaaagtggctaatagttggggaacaaaatggggtgaagatggatacttccgaattgctaggggtaccaatgaatgtgaaatcgaatcattcgtgcttggcatatgggctaaggtagacgataaatttaacaagcgtgttatttatcgaccataatttgtcatctatggtgttacgacgaagtaatatatagagacgaaggtaccatgttaaatgttaatatatctctatcagacatgagttaacttctctctatagattcttcaatattacattaacggtatttttttatgtgaatagcacaataacaaagttgtggaattttttttgatctgatgtgttcttctttaaactgccatatatagaaattgtgttcagatttgaagcgcactgttgataaatcatttttatttatttctacgtgttaacgtcaaaatatacatgtctattttaggttaaaagtttatattttttctttatcgtaggacctaattagctagatttaggcttcaattgtatatttacaaataccggcttttcgttgattgatactcatttagttacacttagatgtaatttcttaataaatgaggttgtacttgtaaacatatgagagatatttttcagatattatatattttatatgtataaatgtatgcc

SEQ ID NO: 156 - DNA, 1497 bp, Rhynchophorus ferrugineus
ggcgtctcgattgtcaagtgtttaatagcaattgttcagtatgtcattcgtttgttccttggtggttgtatgttattacagacataatattttataattcattgtgctattatttcactagctgatatataaagctaaggtgcgtaaatcatcatcgccgttaatatcgcaaaagctcgtcagagccagagaaagtcttcgtgcttggcgttgaactctcgttctcttctgtttaccagcgaagccattccagtcaacatgctcttgtggccggtgtttctatttgccattgtgggtcggctagtgcacggccatggagtcattagtgcagataatccacctccttacgtgaagcaatgtcgtgaagacgacccccagattaactcatgtctcatcagcgccctccaccatttacgaccttacgtggccacaggcatcaaggaaatcgagctgccctcggtcgagcccttcctcatggacgaactgtcgttatccttaacgggaggtgagaacgggtacaagatatccctcaaggatatgaagatctacggcgccagcaacttctccatgtcccgtttgaaattatcagaaaatggtaaacctttcgaggcgaagatcaacataccatcactgaagataaacgccagatatcagagcagtggtgtcctgatcatcttaccggccagtggcaatgggaccttcctaggccaattcgatgatctggactgtatattgaaaggaaaaaccagcaccaacaagaaggacaatcagaactacctgcacgtagatgggttacatgttgatctcaccgccaaagatatgagaatgatggtgaaagatatattcaagaacaatcccattttgaccgaggccataaatctgtttctgagggaaaacggccaagaggtgttcaaagtgatgatgccacagctgaggaagaaactggctgccctgttcatgggaatcgccaacaaactactgacccacgtaccgatagacgcgttttatttaccacgaagaacctgaaggacgccgtttaacaatccattagttttagagacaagcaataaatataaataatcttatttcgaataagtatttattttgtagatagtttaaatagcaattaaagtttattattaccgggtcattagtattttttgcagttgtgtaaaaatggagacggtgtattgttgtatattttttgtacgacacgtcggtcgaaatgtccccggtctaaaaatagcgtacctggtttttttgttcggaaaatgttgatggactatattgtaaaaggtaaaagtaaaatattttgcatattacaggaggtctgcaaaaaattctaagagatgtttaggtttggtgacgtgatcactatgttttaggatatgctgaattcgaaaatgacttttttttgtcataggacgacacgtttcttgataattttgataattattttaagagttattacattaaaataaagatgttacacttaaa

SEQ ID NO: 157 - DNA, 2326 bp, Rhynchophorus ferrugineus
aaatgacagacatggaatcacaaggaatggttaatatttcccttacagaagataagaaaagtatagaagaggaagaaaaagaaaaaaaacatgaatttgatgaaaaacaattaagtgaagagaaacgggcacttaaagaaataaaggaaggtatggaggtgaagcccaagaaaatcccaataggtggtattcaaatgccagggttttttaccaggagcaaatcaaaggagcagtgcaaggatgatgatcaagccgaaggtacagagcttattgagcaacaaaacgatgttaaagaagatgtttcttcacaaactagagttaaactaccaaatccttttaagaaaaccaagccttctgatatagaagaagtatctgttttccaaaagatgaaaaagaatcctgatccacaaactattaataaccaaaatacgcaagcagggttagcatctgttgaaaccttagatgagaaaagtaataacagcacgactgatggtaaaggggcggcccgtgatgagaaaaaagagcctgagaatgatgacaacgatgtacattggacccagagagcgaagacttacaaaatagcgattggtgccttgctatcatttttgattcttataataattattgttactctggcaatgagaggaaaaatcccgatagtttctccgcctattacaaatggaaaatttgttgagacaattactagttgtggtaaagtagagggacaaatggaagatagttcctttgcttttcgaggtataccatatgccaggcaacctattggagagcttagatttaaatatgctcagccacttaataaattgggatattgctggaatgataccttcttggctcataatgccacaccaacgtgtttacagatattgggaaatggaactgttactggtattgaagattgtttaactctggatatagtaactccgtatatcagatatgacaatccccttcctgtaatcgtattgattggcgcagatagtcttgttggcggttctcctggtaaaatgaggccttcagctagatatgccagatctagagacgttgtgtttgtccggcccaatttccgattaggcgccttaggattcttatcattagacattctaagtcaatcagattacccccatacatcaggaaattatgggctttccgatatattagaggccctcagatggattcaattaaacatagaacattttggtggagataagaactctgtaactttgtttggacacaaagctggcgctaccttagtcactgctctgtcaaccataccacaggcgaagaaatattttagcagagcttgggcttcatcaggtggcgcaaactacccgcaaaagtctcgtgccgaatctgaggccgactttaaagtattcctagagtctgtaggatgtcaagatgctgcgtgcttacaggagatagacgcagaaaagttggtcacttctgttccggatacatggagaaagcctcagcctgatctgccaagcaaagatgaaaaccccaaagaaaaacaccagtggttggttgttgatggaaacatattgagagaaaaccccgaagaagtatggagcaaaggttctttacctgttaagttagttatcggatctacagcgcacgcaggcagttcggataaactattactcaaacataccaactggaccgagagtctggttaggcaccatgtaaaagaatcacatctaggtttgcaaaatctcacagacgaagtacttaaaatgtactcccccacatatcaaggtctgagcgctgccgtgacagatgttcggattgcctgccccttgtttgctatctggaccaaaatgcaagataccgctttctatatggtaaatcaaacaaggggtgtgaacgaactggccgatattgaatcagatatcgacgctatattgggcagatacgagccgaaaacgccagaacagcgaaggtatttctcggccatgcaaggtctgttctatcatttcgtttggcatgataaaattgaagagaaacagacaagtaagcaggtcatcatagttgaccaagacgcattacataactccacctattcgcactgtgcttattggatgtcgaaaaacattgttccacttttcgcggctctcgattaaacttattctctaaaattctcttatatttataacatgatgccaaaacattttgataattttcatttgaccacacaaaaatgccatattccgcttgaaacatataccaaaaaaatatacaatttacaatttttcacatctactaaatatagaaataatttattgtcttcaaacaattattttatcagattgat

SEQ ID NO: 158 - DNA, 1519 bp, Rhynchophorus ferrugineus
cgtcaacatcattaagataaaacgaagaggctagtatagtttgaactttgacatggttgagaagtaatctttttaagttcttaatgtatcgctaacaatgaaaaacctgcaactgatcactttattgtgttttctatattatattagagctgatgattcctcagccaaagcagtcgatccacaaacgactcaggaacatgagaaaaagctcagcgaatatgttaatgttatcttggagcactacaaacaagaaaatcccgtgggcatcccaggaacccctatcccggatccattaccaatcccgccgctaagtcaatcatttagtgttggcagaatgaactttcgtgatatgcagttgtacggtttgaaaaaatttaaggtggatcacgtggttgccaacttggcggatatgaatgtaaaagcagggatactttttgacaaattggacgttattggaaattatactttgagaacatggctttcaagcgctcaagggaactttaccgtaaagcttagtcatgttttcgtaacatccattgcgacgttagaagtacaacgaaatggctcgctggaagctcaagacatcaaaatggatattacgttcaaaaatatggacatggattttcgagggctcggatttttcgcgacaatgtttcaaggcataataaattctgtaggaacttttgtctttgactccattaagccctttatgctaaaagaagccaacactaatatccgaaatgacatcaataaacaagtatcgaaaatatcccagaaattcccgaattcaatatcaccatttgatcagttaatttctgaggtacgaaaaaaagttcgcaatatgggttatgacccttataaattaccagactataacaacagtgttggtgtttttgatatttaccttacccacacatggctgaatggtctttcaagctttcacagaacaaaagatatcattgttgaactgcgaaacaaaacagtgcatacattgcttgaagtaggcacccaaaaacttgttggtactactcattgggaagtttcattagttgctggtataatgtcaagattaggaattgcaactttcagcgtagaatatgtaaaggtgcaaataaatgccagtcagagtatggatacgagaaaaaggccatctttagatgatattcaaatagaaataggaaacattcagataagatttgatggacttggtacaatggactatattatagaatttggaataaacgtaatacccaatctacttcgatatcagatcatggatgccatagaaaaaccaataaaagttaagatacaagaggaattaaataaaataaacgtggagcagttgataaaagataatgcagaacgattagaaaatggtgatggtttttctgattttgggaaccttttgtaaaatatagtataataaatgtgtaaatatttttcttaaatataaacaatggagatatttctgggtaaaccttctcgaagaatattaaattagtaataacagataaatgag

SEQ ID NO: 159 - DNA, 680 bp, Rhynchophorus ferrugineus
ttcgaaaaatcacgtccctacctaatcaagggcatcccggagctcagttttcccccactggaccccttcaaggtacccatcatgaccgtcaacaggaccctcaatgaactggtcagcatcgaagctatatgccgtgatgttgttcttgaaggaggaagaaacaccatcatagacagcattaaagctgatattgatcgagcttacggagaattgagagtgacggtaccctggtttgccatggaaatggactatgacgtcagcggaaggcttctatccattcccttgttaggcaagggtcatttcaaaggaaatttcactgatatcaagttgtccgtcaagggatccttggaaaggtatcaaaagaaaggcgaagactatttcagggtgaagaaggtcaataccaagggcataattggcgatggttgggtgaaactaacttctaagaatcctaacttacagcttggagctgatatcatcagcaacttcttcaacgagaatccccgaagaactatggacgcaatcaacccgatattcgtcgagacctacaatgagctctttagagtgatcgccgatcagatcttggtgaacttgaaggcttcagaatggctgccagcttaaagtgaaccgataacaagagaacagtgttagttacgttatagtacctgtatttttcaattttt

SEQ ID NO: 160 - DNA, 764 bp, Rhynchophorus ferrugineus
ttcgaaaaatcacgtccctacctagtcaagggcatcccggagctcagttttcccccactggaccccttcaagatacccatcatgaccgtcaacaggaccctcaatgaactggtcagcatcgaagctgtatgccgtgatgttgttgttgaaggaggaagaaacaccatcatagacagcattaaagctgatgttgatcgagcttacggagaattgagggtgacggtaccctggtttgccatggaaatggactatgacgtcagcggaaggcttctatccattcccttgttaggcaagggtcatttcaaaggaaatttcactgatatcaagttgtccgtcaagggatccttggaaaggtaccaaaagaaaggcgaagactatttcagggtgaagaaggtcaatgccaagggcatagctggcgatggctgggtgaaactaacttctaagaaccctaacttacagcttggagctgatatcatcagcaacttcttcaacgagaatccccgaagaactatggacgcaatcaatccgatattcgtcgagacctacaatgagctctttagagtgatcgccgatcagatcttggcgaacttgaaggcttcagaatggctgccagcttaaagtgaaccgataacaagagaacagtgttagttacgttatagtacctgtatttttcaatttttttacgattgttttgttttaaaaagttgcactttttataattttttatcgactttttatataataaaacaaaaaaaggtcttaaa

SEQ ID NO: 161 - DNA, 1500 bp, Rhynchophorus ferrugineus
tcggcctgcggtgcatcatgacgcttctcgttctcgtcgccgtcgcaggttttttatacctcctgaaccggatcctgcgttattacaagacgtccaggattctatcgaaagttccctctcccccgggacattggcttataggaaacatggatataatattaaaaatcaatccagatgattttttcgatttattgagggatttcagcaaaaaatatggatccatctaccgcctcagtaccccatatattacaacaatcaatatttccgatcctggcgatcttgagatgatactctcacaacccaagcatatgagcaagagtaaagtgtatggtttcctgcaaaattggcttggagaaggattattaaccagctcaggactgaaatggcaaaaaaggcgaaaaattttgaccagggcatttcatttcaacatccttcgacagtttttggacgtttttaatgacgaaactgacaagctgacccaacaaattcgcgatataaacaacgagaacacggtaccggcttacatcgacgtggtaccactaataagccacatgacgttgaaagcaatgggtgaaacctccatgggcatgaagaacataaccgacaccgaggtggtactctacaggcaatcgattcataaaatgggaaaattgttgttggaaagaatcggctcccccttgacccgattgtcctttatctacaggctgacgaggaatggtcgcgaagagaacagaaccatacaccagctgcatcaattcactgataccatcatcaagcaacgagagaagcagatcctgaatttggacagactggagctcgcgtcttcgtcatattccgaaaggaaattgatgagaatgctggacctgctacttctggcaaaaatcgatgacaacagcatcgattacgagggtattagagaggaggtggacacgttcatgttcgagggccacgacaccacagcggtcgctttaagtttcctgttgcattctctggcaggatgaagtacgtagggagctgagggaggtgctgggagacaagccccatcccacctacgccgatcttcatcgtctggagtacaccgagagagtaatcaaggaatctctgcgtctataccccagtgtcccgttcatatcccgaatcgccagcgaggatatcctcacctcgacgggatacttcctccccaaaggcaccgtcctccacatgcacatattcgacctgcatcgcagttcggaaatatatccggacccgctgaaattcgacccagaccgtttcctgctggataactgctcgcagcgccatccgttcgcctacctgccgttcagcgcggggccccgtaattgtataggtcagaagttcgcgctgttggagcttaaaagttgcctgtgcggagtgctgagaaaatacagactagagcacgacggcaagaacgagttcaggttcgcggcagatctggttttacggacaaaggacgccatcaagattaaatttctaccgctgagt

SEQ ID NO: 162 - DNA, 2929 bp, Rhynchophorus ferrugineus
cgtcatactcctatcgttgcggaggctgaatctatccagctgcaggtacgttcaagctccactcagtagcggattcggatcattttcttccggtgtattttcctggcgagttcgtaaagtagccggttgcgttagatagtacctttctcggatttgtagcttggcacaaccgacaaggtgatccggcttggcttcggggtacctttagcgaagtagtaaaatgccccagttgtctggaatttgttgacagttattaagtccggcatagtccggttccattatcaatatgtggtggagatgttggcccctagtggggctcctgttagccatcctggcacctgtcgctccatctcctcgccgaggaagacatcgaaccgtccccgatgcacccagagccgagcctctaatggctcaaaaagtcacacctcaacgacgagatcccttcgatccccataaagattctgaggagttccgtagagacgcacctgatgataaaagagatttcgcacatcgtttgtctaatgatgaagatccccttgtaatacgtacaacgaaaggcaaagttagaggtactacattaacagccgccacaggaaagaaggtagatgcttggttgggtataccgtatgcccaaaaaccagtcggttcgttgaggtttcgacacccgcgaccgtatgaaaaatgggaaggtgtcttgaatgctactaaacatcccaattcttgtgttcaaataatagacaccttatatggagactttcccggtgctacaatgtggaatccaaatacaccattgagtgaggattgtttatatattaatgtagtagtacccagaccaagaccaacgaatgccgccgttttagtttgggtgtttggtggtgggttctattcgggaaccaataccttagatgtttatgatcacaatattttggtatcggaagaaaatgttatcctgatatcaatgcaatatcgggtagcatcactgggctttatatatttcggaacacctgacgcaccaggtaacgccggcctattcgaccaactcatggccttacagtggatccgggacaacgttgccgcttttggaggaaatcctcaaaacgtcaccctattcggagagagcgccggagcagtgtcggtctcgttgcatttattgtctccgttatctagaaatttattttcacaggctataatggaatcaggtagtgctacagctccttgggctattatctcacgcgaagagagtgtattacgcggtcttagattggcggaagctgtgaaatgtccacacgacaaaaataatatagcagcagctgtcgattgtctgaagaaaaaggaccccgtagaactcgtcaacaacgaatggggaacattgggaatttgcgaatttccttttgtaccaatcatcgatggtgcctttttggatgaatctccggtccgtgcattggccaacaagaatttcaaaaaaaccaacattttaatgggatccaacacggaggaaggttactactttattatgtattaccttacagaactattcaggaaagaagagaacgtctatataagcaggcaagagtatttacgagctgttactgaactaaatccgtacgtgggtccagctgctcgtcaagctatcgtgttcgaatacaccgactggctaaaccccgatgatccagtcgctaacagagacgctttggacaagatggtaggtgactatcaattcacctgcaacgtcaacgaatttgctcatcgctatgcggaaactggcaacaacgtctacatgtattactacaaacatcgaacgattgcaaatccatggcctacttggaccggcgtaatgcacggtgaagagatagcttatgtgtttggagaaccactcaatcctgccaaatcgtataccgcccaagaggtggacttatcgaagagaatcatgagatactgggcgaatttcgccaaaactggcaatccttcattggctcctaacggtgtttggacggcaacgttctggcctttacacacagcttacggtagagaatatctcacattagacgtaaatagcacagccactggtagaggcccacgactgaaacaatgcgcgttttggaagaaatatctgccacagctgcagcagcttacggtagaacaacagaagcccgttccacaaaattgtactaacgcaggaacaaaacctgcatatgcacactatcagagtgctattggagtgacaatgcccctaatacctcttctactcaatttgtttaattgggtgggtgcgtagaaaacactaataacagaccaaaaatggagttgcataaaattaacaaaataaaaaactaaatgaagagaaaactagatgggcgtaacccctcatagagctgtggattttagaaaaataaaataaaatttcgctttttgctgtttagaagacccacctggtacaaagtaatttgaagatgtgaaacacgatccaatttgagaagctttggattaaaaccttgatcagtcgctaaaaaaatggcaatgcatgttgcaaatatcgacattaattgaaaaaaataatggagaattattattgtgaattctcgcggtacttattatataagttattttgaaccccccgtagttagactacactgtaacgtatttatatatcaaactttaattctaacatgttaataacatgttaataaggatcattaaaaataaggatctcaaaatggcggttagtgaacgtttttcgagatagttttcactgcttttcaagattttaacaaccaaagttcttgaaccaatgatgtaaagccaaatcaatacgaaatataactctttatatggaatagtatctggttgcaattttattaaaaaaaaatactttttactatctatataattttcgagctcaaagtttacctcatataaaatttaatgaaga

SEQ ID NO: 163 - DNA, 1627 bp, Rhynchophorus ferrugineus
tgaagatctatgaggatgacattggagatttttagtacctttgttatgttagttcgctagacttgctagtacgtaaaattgtatccatggaaaagtgtatagttacgccgatttcttatatctatttcgttatcaggagaatatttcaaagcataacaagatacatcaagtgtgttgcactagctttacgtcttcccggacctgaaggcgcgcccatcgtgggatttataccaaaacttagggacaacaagtttttagaagatctgggtactaatgcatccaactatttcggccctatatttcgaatatggatattgttcatgcctttcgtttttatctacgaaccggaggacctaaaagcggtactggcacatggaagaacgtcagagaaaagcttcttttataggatcatgcatacgttcattggcgatggcttgattaccagtaatggggagaaatggaaacgtaatcggaaattcattcagccgtacttccaaaacaacttcctacaaaactattacgaaatattttcccgatgttctcttaagttagtacagaatgtaaacaaccggcgtcaagtcaaggtaacggaactaatcaatgattgtgtactgggtattctgcatgaggccatcttaggggttccatcgggagagacaaagaacagtccatttagaaagggtgagctgctactgctaaaaaggatattgaagccatggttattgcttgatggcgtgtttaaatgctctggaatgtccaagagggagaagaagcagcagtctgcattgcatcagtatgtgaaaaggttgctggatcaacggctggatgaccgaaaagataaccaaatcaattggagtacctgcctcttggattacttcattgatttgatggaaacaactgattttactcaggaagaccttctcaacgaatgtgtaacatttatgctggcgggccaggactcggtaggagcaacgatagcgttttgtttatattacttggcaaggaaccagagtatccaggaaaagttattccaggagatcgatatagtaacgcgaagtaatgattcaggaaagattgacatggatcaggtgatgaggatgccttacttggagcagtgtatcaaagagacccttcggctggcgcccagtgttcctgtgatctccagggtattgacaaaagacgtgggtttagctaactacgttttaccagccggtttgaatatattcatatcaccatttatgactcacagattgccacacatcttcccgaatcctgtagtttttgatccagatcggttttccgaagaaggattgaagaacattcctccatacgctttcattcctttcagtgctggtagtagaaattgtatagggtataaattcgcttatctcgaaataaaaaatattatcgcgatgttggtaaaaaactatcgcttaacgctgatatctggtaaggataacctatcgtttagttacagagtcaccctgagagcaaattcaggtgtaatgttggagttcgaacgtagagcttaagtattcggaatgtttcatataatggtttaaatttttccaataatacgggtgttcaatatgcgtatagagatgaataaactttatggaattagaaa

SEQ ID NO: 164 - DNA, 925 bp, Rhynchophorus ferrugineus
tacttattattttatcgttgtaaaacaccgcggtattaaaaacagaaatatgaataaatatcctgtagtttcagttttcttagtatgtgcatcatttttacaacaaagagctaatgcagatataccttcttatctgaaagtctgcaaaagaggtccagattttactaaatgcgcaatagccaacggaaatgctgccttgccagagatactcaaaggaaacaagaaattcaatataccaaatatgttaccactgacttttccagtgatcaatgctcaagctggttctagtttaaagataaaatttatggatctgaaggttatcggattagagactgtgaaattggtggatatttcagtggattttgacaaacactcgatatatctgattgtgcatgctgataagattaccctagatggatcatatgaagtggatggaaaaataatggtactggctgttcaaggcaaaggaacgtgtaaaattgatattgaaaatggcacttttagatattcttttacatatagaatagaagaaatagacggcgtcgaatatggacgtatggatcctaatgataagctcgaattcaatatagaaaaggctcacttcaattttgacaacctgttcaatggaaataaagaaatgggtgataatgtaaacaagtttttaaatgaaaattcacaggatattatcagagaacttacatacggatactatagacaaaaccatatcgtctattgctagacaagtgggaggaggagtagtagagaatataccctataaagaattatttattgaataacacaaacacgtgaaattctcttggcaattgttaggttcaacttgttttttactcttattattgtttacagaataacattaataccgttattataatataattgccttataaataatatacctgtcaaa

SEQ ID NO: 165 - DNA, 637 bp, Rhynchophorus ferrugineus
cagaggacgtccaggaaattgttgaccaatttcgggcgttatacgtggccacatcaaatatccggcatcacgatgaatacactgacgctgacttcctggccggtatttttgaagggatcagacttcatctgaaaaccagggaccacccgatttatctttacagaatatcgattaacaccgaccttaattacgtgaaacgtatcatgaatatcctacgagaaccaggctgttctcatggagatgacttggggtacttgtttcatagcttggtgagtccggagataagaccgaatagtatcgaggagagagccatgaagaacttcgtgaaattgtggacgaatttcgccaagttcggacgacccacgcccaaagagtatatgtcgatagtttggcatccgattaccgatgagaataatatgaaattgttgaatatcgataaggaattagaatacagggcggtgccggagaaagagagattgacagtgtggaggaatattttgaaaaaatggccctactccagatataattgaatataaaataatatcgtttatttatataagtcctggcgcattcaccatatatatggaataatttgaaatattttaataataaagttgatatttcgtctccttgacaa

SEQ ID NO: 166 - DNA, 1980 bp, Rhynchophorus ferrugineus
tgagatcgaggaacgtcagtttacgtcaaaaatgtctttttaaaaaagaaatgttggaaagctctgggttttcatcttgcagtcgatagcaaaaaatatacaagtagttgcaattttattataaatattgaatttccacattcactatgagtaacgggatcgaggagaaaccaagtgtttctacagaagatacggaacttgctgagaaatataagtcggaagcaaatgattattttaaaaaacaagattataacttagctattgaatcctataccaaagcaatcgagaaaaatccaaccaaggcaatatattatgcgaatcggagttttgcatttctcaaaatagaatgctttggttatgctttatctgatgccaccaaagctattgatttagataaaaactatgttaaaggattttatagacgagcagcggccaatatggctttaggtaaatggaaagaagctttaaaagattatgaatatgtaaccaaagtgagacccagtgataaagatgctaagctcaaatataatgaatgtaataaaattgttaagaaaatagcgttcgaaaaggcgatttctgtagaagataagaagcaaagtgttgctgatactattaatttggatgtaattactattgaaaatggatatagcggaccggaaatagaaaatggtaaaataacattaaattttatgaaggaattaatggagttgtacaaaaatcaaggcaaattacatagaaaatttgcttataaaattttattggatattaagaattattttatggctcaaccttcacttattgatgtctcttttggggacaaagataaattcacagtatgtggtgacatacatggtcagtactatgaccttttaaatatttttgaactgaatggtttaccatcagaaacaaatccctatttatttaatggtgatttcgtagatagaggttctttttcagttgagtgtatatttacactttttggttttaaattactttatccaaatcatttttatatgtctagaggaaatcatgagagtgccactatgaatcaaatgtatggttttgacggtgaagtgaagtcaaagtatagcactcaaatggcagaacttttcacagaagtttataattggttaccgttagcgcattgtttaaataaaagggtattggtgatgcatgggggtttgttctctcgcgatgatgtcactttggatgaaattggacaaattgatagaaacaggcagcctcccgaggatggaccaatgtgtgagttactgtggtcagatccccaaccacaaaagggtagagcccccagtaaaagaggagtgggatgtcaatttggaccagatgttaccagtaaatttttggaattaaataaattagactatattatcagaagtcacgaggttaaaagtgaaggctatgaagttgcccatgatggtaaatgtatcactgtcttttctgcgccaaattactgtgataccatgggtaacaaaggtgcatttattgtgctaaatggtaaagatatgattccaaaatttacaacttacgaagctgtgagtcatcccaatgtgaaaccgatggcatatgcaaattctttacttacaagtttaatgttctagtacctggcatttattgtagtgtaatttatagttattttctaaaaacaaagttattttttgtttgttaaataatgatgcaatacactaaacaaattttattagtgattttttccttgttgacactgtgtcttaaatccaaagataaggaactgctggacatattgaagggtttgtttcattataattacggccggtgataagaaatattcatctcaattatttgttttccattgttttgttatacataaatgtatattgtcatgatccaaaatgaactgccttcgactgtcgttttttgagagattaaatactagacaattgtatgttcaatatttctaaatattgttcccatttttgatag

SEQ ID NO: 167 - DNA, 1330 bp, Rhynchophorus ferrugineus
gcaccaaaacacagtctagcctgcgtcgtttgcgatagcgttcgtcatgtttatttcctctattttagtgctattatgtctcgttgctttttacgtgaagtggcgttataattactggaataggcgtggtctccatcagccgaagccccaattccctttcggtaattttaagagtgaactcacacgtgaaaaatcgtttttcgatggaaactttgaattgtatcaacgactcaaaggctccggtcacaagcacgctggagtttatctgttcctggaaccggtctatcttcccgtcgatttatccatcatcaaacgtattttgttcaaagatttctcccattttatgaaccgtggcgtctaccatcatccaaaggatgtgttaactatgaacttgtttagtatggaaggggaacaatggagagcattacgggccaagctgacgcctactttcaccagtggaaaactgaaaagtatgtttccaatattacaggctaatatcaaagttttggatcgagttgttggtcataactccgttaacaagacaccagttgatattaaagacgtggcctctagactaacaacggataacatagcaagttgtgcgtttggtctcgagtgcaattcactagaagaacaagaaaactccttccgcacctacggtcgaaagatgttcgagccccaaccactgaagatgttcatgatcgagttccttcccacttggttactcggctctcttggcttcaaagctcaacgaccggatgttgaacatttcttctccactaccgttaaagacaccatcaaactgagagaagaaaacaacttaatgagaaatgacttcttgcagttgctgctggagatgaagaaggaccaaaccttgaccgtggacgagatcacggcccagtgcattattttcttcttgggtggtttcgaaacgtcagcctccgccatcacctttactttgttggaactgtcacgaaatccaggtatccaaaacaaggttaaacaggaaatatccgagattttgaaggaatttaatgacgaaatcacctacgattccctaatgagaatgaagtatttggatatggtcatcaatgaaactcttaggctatatccaccattgcctgttcttcctcgtatctgctccaagacctaccgggtaccgggaactgaagtggtcatccagaaaggaaccagagtaaacattcccgtctggggcattcacaaggatccagaatactatcccgatccagagaaatttaatcccgaaaatttcaccgaacaaaataaagctgatagaccggatacaactttcttaccattcggggaagga

SEQ ID NO: 168 - DNA, 583 bp, Rhynchophorus ferrugineus
ttaattaaagagttactagtaagaattaatcattatagcgttatcattcttagtagtaggacaagttgtataaaacctatactatctatatagatagtagtatacataatcatagatatttaaaactcaaattaaacatcgagaacaacattacagtaatattggaatttgtgcagacataccatgattgtcattattttagtgttaagtgttattgtgcttatattgtggagtatttggagtaaacatcatattaggaaaaaatattttcaaaatgttcccggtcctaagcctgtaccgattttcgggaatactttggatcttatagcaggacctaaagtatttctaaaaactatatctggttggatggacatatttggtgaaacaatattagtacatgacgggcctttaagtgttctacttatgactatggattatgatcttactcaatttatatacaactcttctgatcacatagacaagggataccaatacacctatcttcatggttggttaggcaatggtcttcttacatcgactggacttcattggaaactgcatcgaaaagcgataacaccatctt

SEQ ID NO: 169 - DNA, 1595 bp, Rhynchophorus ferrugineus
gtacatgttgttgtttcttcgcctcgctaaaatattcagattaattttgaatgaacactgatttcaaacgatgtcgctagtgttaatgtttggtttttccattgtcgtctcattgttggtaatattattgataattaggcgaccgaaacgtaccaaaaagtacttggaaaatgtaccagtaccaaaaacaacgtttatatttggaaatgcgttagattttatgaaaaatcaagaatatttgtctgtcctaaaaaagtatttggatgattatggagatactgttgtaatcagaattggtcctttcagcaagttactgattactgttgattatgaattttctgaatttttatacagctcaacagtcgaaataaataaatctgaccaatacaaaataatgtacgattggattggaaaagggctgctaacaagtgcaggataccaatggagagctcatagaaaagtgataacaccatctttccatttttcgatcttgcaagatttcgtggaaatattcgaacaagtgggcaatagattagtcgataagctaatgggcacagaaggccaaaaaagtgtagaggtctttaatatagtatcccaatatgcacttgatgtgatatctgaagctgcaatgggagtaaaattaaatgcgttggaagatgatacatctatatatgtgaagaatgccaaggatctttgcaagattttaatcaagaaagcattttcgcctatcaatgagaagctatacccacttactttcatgcactataaagaacaaaaacatttagatgttatccatcgttatgtcgagaatgttatacagcaaagaatccaagaaagggaagctaaactaatagttagtgatgaaactaaaagtaacactggaaaaagaaaaagattggcattcttggacctattgttagaagctagaatcgatggggaacctttatctttaagggagcttcgtgatgaagttaatacatttatgttcgaaggtcacgatacaactgccactacaatatcattttgtctttatttgctggcaaaacatccatcagttcaagaaaaagtactagaggaacagtatgccttattaggagatgatttgaagggtgtcaaagccacatatgccaacctcaatgaaatgaaatacttggagatggttattaaggaaacactgcgattataccctcccattccttttgttggacgaaagttaacaaacgatgtggaatttaatgggacgatatatccaaaggatataaatattttgttgttcacgtattatgtccaccgacaggccaaatattttcaggatcctgaaaaatttaatccagaacgttttgcatattctgaaaggaagattccttttgcttatattccctttgcagcaggttctagaaattgtataggacaaaaattcgctatgttagagataacatcggctctctcgaaaatcgttaggaactttgaactgattcctgccattcccaaacatgatcttgaaatcactactgaacttgttctagtttcgaaaaatggcatgagaattgcacttaaaaagagattttaatgtatagcatagatcggaagagcgt

SEQ ID NO: 170 - DNA, 210 bp, Rhynchophorus ferrugineus
ctattattatctattcagtcacagaggatccgcgagcttcacggaaatttttggaggtggagaagaagattacggtgtttgccatgctgatgatctacaatatcttttccctgttggagacggcttatttcctgaaagaactcccagcgaatctgataaaagagtggccaaaatttttaccactttgtttgccaatttcgcctacactgg

SEQ ID NO: 171 - DNA, 799 bp, Rhynchophorus ferrugineus
gcttaggtaactcctacttggatttcaaaatgattgcatttacctcacttttccttgcagtatgtttagtcagcagtgccacggcaggagttttaccaaacgtgggtaaatgcagtcttgaagaccaagcctgtctactaaaggagttccaaaatgccgttcccgtgttcttcgggggaatccccgaagatggaattgaggtcatggatgtcatgaacgtgaatgaagtatcttttgacctctccggcttgcatttcggcttagcagatggaaaacttaagggtctcaaaggagttgtaatcaaaagcgtagactggaatacgaagaagcaaagaataacagtagattttttgtctaactgtactatcaagggacactacaccgcttctggtcaggttttgatcctgcctattactggagatggccagttgaaactgaaattgagagacttagaagttaaaatacacatcgactacgacctgaagaccggcgccgatggtaaggaaagagtggtgccaaagaaaatggcatacacgttcgacgttttgggaaatgctcacttcgctctcacaaacctgttcaacggaaacaaggatctcagtgacgctatgcacaaattcttgaacgagaactggaagcaggtagcacaagaattcggaggaccattgatggatgtaacttcgaagcaaatctacaaaaacattgagatattcttcgacaagaacccaattcatgacttaactttgtaatttgttatagtagtttaatttgtttttatttaaatttggttggttataga

SEQ ID NO: 172 - DNA, 1829 bp, Rhynchophorus ferrugineus
tgttaactcccatttaattcctatcatacccctatgtaataaaagtcgctatagccttggcaaattaaatatgccgatttgacatttcggttattgtcaaatagtcaatgttaagttgcggctttgtttaaagtgttgtttctgttaaaaatgtggagaatatcgaaaatacgagcaaatgtggtattgggaattagatattgtgccaccgaagccaagtccaccgcgtctcagataactacccctttggttgatggtattccacctccagcgactgtcgtaagaaaggaaataccagtagtgaagaaaattttaacggaagttaaagaacaagatggtagaagcaaaattatcgaaaaattttgcgtcttcgatgatgtaccaggtccgaggagtctaaaattaatttccaacatatggagtcacgttcccgctttaagtaaggagtttactgccggagcactttttcagactgatcggatttggggctcagttggggcggtaacgcaagctttttccaaaaattctttgacgtttatggtcccgtggtgagactgcacggccctttcggtggcgacgtccttcttttgtcccgccctgaacatgccagtattgttttccgaaacgaaggcacgcggcctgtccgggcttgtttggattcagtggaaaaatatcgtctggagcatcgaagactgagacaggcaggtcctttcttgatgtcgggttctgcttgggaaaagatccacgattccatcgatgatcctataaagacttccgtaaatcgatacgccaaaccaatgaacgagatatgcgatgagttcgtcgaacgcgttctgaatattagaaacttacaagacgaggtacctaagaactttaaggacgagattttaaaatggtgtctggagagtatgtgtgccgttacactgaacagaaagtttgggtttttggatacaactggtttaagtaccacatcggaccctggaaggattttggatggagttaatggtgctactgaagctatcaggaaatgtgagtttggtttccatctatggaaatttgtggagacaccggcttggcgttctctggtgcgtaactgcgactcgatcgattccattctgagtaaatacgtagaacgagcccagaccgcattacgtgaaaggaaagatctgaacccaaagacggcggatttttccgtagtcgaccgtttgttgctcaacgaggacgttctaatcgaagatgccatgaccgtcctgctggacatgttcatcatcggcgccaacgccaccgtgcactccgtggcgtttctactatatcacttggcgaaggctcctaagtgccaaaagaagctacaacaagaaatcgacgggcagacccgcaccgaactcaccgcagacgatctgaagcgcatgccttatctgcaggcctgcatcaaggaaagcttacgactagcgccaccgataccgattttgaatcgcgtactcgcgcgagatgctatcatccacaagtatttggtacccgaaggcacgtacgtcctaatcgccacccacttggccagcttgcgcgaagagtatttcgaagatgcccgtcgcttccagccagaacgttggctcaaccaggaagtcggtcgtctcgctcgcgatcttcaggagtttgcttccatgcccttcggtcacggtccccgagcttgccaggcgcgcgagcttgccgagatgcaggtgggcttgctggtggccaaggtcctgaagaggtttaacatcgaatataattatggggagatgtctagctcaaatttgatgctctccagcccaaccaaacagatcggaagagcg

SEQ ID NO: 173 - DNA, 374 bp, Rhynchophorus ferrugineus
gatgaagtttgatcctgatcgatttacagcagaaaataaagcgaagaggccttattgctcatatattccatttggggaagggccaagaatttgtataggaaaacgatttggaatatggcaaagtaaaatcggtttggctaacataatcaagaactacaatgtgactttaagtaagaaaatgaaactaccagccaggttcgataccagtggattgatcttgaaattacacggggatatttgggtcgatcttaaaaggatttgttaaagttttatttaatagctattaatatttataagtgattataaaacgagataaatatatgtatatgtagagtaatattttttaaataaatttagcgaggcattaaaaatag

SEQ ID NO: 174 - DNA, 1016 bp, Rhynchophorus ferrugineus
ctttcagaaaaatgggccaaaattatcaaatttgtataaatatcaacacaaatgcttcatgatagattaacttatcgaatcgtttagcctaattattatatttcacacgacagtatcaaaattgaaagatgaaaattacgctttgttcgctgatagttatattgcacatatcgactatatttgcagatgatttcgatgaattccagatacaggaaatttcgaatgaagttaccgctttaaatttaaatagtgatgacattggtaaacgttttaagcagaatattgttctgtcacttttggacattgcagtcacaagactatatactaaacaaacagcagatgttaccaactatacccaacaaatactagacaacttaaagcctattataatagagcagggtttagatcctctagaactgcctgatgaagcaattgatctattgattggtggaagcgtcactttgacaaatggatggctggaagatttttcaacaataggcgtatatgatactgtaaagctgagttacaataatgagactaacataattgaccttaccttacctctaagtttcgacgaactaatgatttcatatgattataaaactaaagttcttctattaacaatatctggagatgtaaaggcaaaaatatctgacgttaagttgagtttgcaccttggattcgattttaatagctatgaagcatttgtggacgaaattgatgtcaaaaattcaggatctattagtttcgatttcagtggattaggattgctagattgggttattgaagcaatgagtactgtactgaccattttattccatgacattattctcggagtcatcaacgcgatcatttacaacccagtagaaaatgtcgtggaaaatcttaacgaaaaaatcaatgaattcctgcatacaaactcaacagccattcaacattttagattaaatatttaaaaatgaccattttaataattaagacattataatgaatgaaattaaatatttcttgaaacc

SEQ ID NO: 175 - DNA, 2220 bp, Rhynchophorus ferrugineus
ctcaagaacactgtttaaaaaatagcacggttgcactcgcaaaaagaaacaaaaaaagagtgagaaagacagacaaacaaataaatatgttcgtgtatagtgcctcgatactgtggaacgcgttaaatgaagacgcgaccaggaagatcctgctagtgttcgtcgtcgtgttactgatcgtccgatcgcttcaatcctggctggaatgcaggagtttgccgccgggaccgtggggattgccggttttcggttctctgttgaaaattaaaggtgatcttcatcttttctaccgcgacctgacgcataaatacggttcgttgatatccgcgagacttggctcgcagttgattgttgttttgagtgattacaaaatgatccgtgacgcgttcaggaaggaggaattcacgggcagacccaataccgagttcaccaacatcttagaaggttacggcgtgatcaatacccaaggaaagctgtggaaagaccaacgacggttccttcacgatggtttacgccatttcggtatgtcctacttgggatcgcgcaaagcccaaatggaaaaaagaattgttagcgaagtcgacgatttccttactattcttaaagcaagcaagggtcagccgatagatctcaattccgtcctggctgtatccatttccaatgttatatgcgacgtgctgatgtcggtaaagttctcccataacgacgccagattcatcaggttcatggagctcattgaagagggcttcagactattcggttccttggagtacgtgttttttatcccgatcctgaaatactggcccggtcacagttacacccgtcaaaaaatcgccaagaaccgtgaagagatggctcagtttttccaagaaacaattgacgaacaccgaaggacattcgatccaagtcatcttcgcgatcttttggatacctatctgtacgaaatccaaaaagcaaatgaggatggagttggacataatttgttcgaaggaaaagatcatgatcgtcaaatgcaacagatcatgggtgatctcttctctgctggcatggaaaccattaagagttccttacaatgggctgtcttatttatgttgcacaatcctgagcatatgaaggccgttcaagaagaactggaccaagtcgtcggtcgtcataggctaccaaagttagaagatttagcttatttaccagtgacggaatccacgatcctggaaattcttcggatctctagcatagttccaatgggaaccactcatgccccaattagggatataaaactgaatggattcctattgcctcgtcacgcccaaatcgtgccgctgcttcacgccgttcacatggaccccactctctggaaggaaccagagaaattcgacccatcccgatttatcgacggagaaggcaaagtacacaaacccgagtatttcttgccattcggagtgggcaggaggatgtgcctgggggaggttcttgccaggatggagatctttttattcctgtcctccctgctacattcttttgaagttagtgcacccgatggtgacaccctgccaaccctgaagggtatcgtcggagtcaccatcagtcctacaccatacaaagtgtgcctcaagccgagaacgattgcatgggagaacgaggacgtgaacctgcggccagcaggaagtcactagacttcttgaacagtgttcaagagcacggtcaaagagtggttcctaagtgaggcacagtacttaagcagattcaacaatatataaaatgggacgttttcgttcgaaacgatcctttatttgatcggctgtgcatttaaagtgttcatattcaccgcctttagtattagatatattgtagtacaattgctagtcaggcatgttcatcagttttacctagttttgcaattccatacaagccatagatttttaccattttgacttgtcattgttgattattattttttttactttattcgtaaccatatttgtgtggggttgtgagtgctactttgttaccgaaacgaaaccatatatttttagatttagactttatttattgtaaagtaacgaaccgtggtcggtttcttatagaaaccctccgtacgatatcaacaatttatacacgcagattgtatcatccatattcatcatcgtaaatataattaacgttgtaaatattttgttccgcaattgtgcttaaaacaatttttgttttttttagagagct

SEQ ID NO: 176 - DNA, 1792 bp, Rhynchophorus ferrugineus
gttcactcgaacatagacagcatagcccacgtttttaaagagaataactatgattggggcgcttgaggctgtctcgacttcaccaattgttcttccgaacttttacatcactatcctgctaggagtgacgttggtcgttgcttcgctttatttatggtctcaatcgctgcgacaggccaaattgacgagcaatgttcccgaacttccaggccggacgctgttatccacagcgttaaatccaagcgatttcctgaagaaaatgcttgaggctatacatgatttgaaatgtgatgtgggaaaattcgggatgggtccctatttcttcatgggactgaaagatcctgtagatgtagagcttattctgggtagccaggagcacttggaaaaatcgagggagtacggcttgttcgaaccatggctaggagatggtctcttaatcagcaaaggcgaaaaatggaggacccacagaaaaatgatcgccccaactttccactcgtccatattgaagtccttcttccctgttttcaacaagaacgccaacaggttgctggagaaattggagaaagagaaaaacaaaatttttgacgtgcatgattacatgagtggtgctaccgtggatactcttctagaaactgccatgggcgttgaaaagacaaacaaggacaatactgggtttgagtatgccaaagctgttatggatatgtgtaatatcttgcatcaaagacattacaaaatctggctgaggcccgattttctctttaaatggacgaaaatggctgccgaacaatcaaaactattagaccttattcacagcttaactagagaagtaattaaacgtaagaaggtcgactatttcgaaagggaatctaagggggagaagagcttgtacaaggaggctgtgcgcgctgaaaataaggcctcgaagaaaaacgccaagactgaaaatatttcttatatccatgacgatttggaggatattgaagaaaatgatataggagaaaagaagaggttggcattcctcgactttatgattgaagctagtaagacggccggtaacaacctcaccgatgaggaaatcaaggaggaagttgacacaattatgtttgagggacatgatactacggcagctgcatctagtttcgtgctttgtctgttgggaatacacaaagacatacaacaaacctgtataaatgagttaaaagaaattttccacgatagttgggagaggccaatcacttttaacgacacattgcaaatgaaatatcttgaacgagtaatcatggaaactctgagaatgtaccctccagtgccactaatttcaagaaaagtaaaccgggatgttaagttagcctcaaacaactacatcataccaagcggtacaaccgtagttgtatcacaattcatgacccacagacaccccagatattggaaaaatcccgatgtctttaatccagataacttcctaccagaaaactgccaaaacagacactactatgcctattttccattcagtgctggacctagaagttgtgtgggacgtaaatatgccatgctgaaactgaaggtgataattgccagtgtcctgaggaagtatcagataacgtcccctaaggcagaatccgagttcagtctgcaagctgatatcattctgaagcgtacagatggatttaacattaaaattgaagatcgagttttcgcttaacaaatagaaagtacatagtgtattataaatagtctatgtttaggaacattgtattgtaaaaagtggaataaatgttatgttgtaagcaat

SEQ ID NO: 177 - DNA, 277 bp, Rhynchophorus ferrugineus
ccaagatatgacatcagaaaactgataccttacgagttgaatgtgaacaaagcagaggacgtccaggaaattgttgaccaatttcgggcgttatacgtggccacatcaaatatccggcatcacgatgaatacactgacgctgacttcctggccggtatttttgaagggatcagacttcatctaaaaactagggaccacccgatttatctttacagaatctcgattaacaccgaccttaattacgtgaaacgtatcatgaatatcctacgagaaccag

SEQ ID NO: 178 - DNA, 783 bp, Rhynchophorus ferrugineus
agcccaaaaccttcaacaaattgggaaggtgtcctggatgcaacgcatgagggttcttgctgtgtagcaccgcaagaagatagtgtaaaatatatccaattcatcttcaaaggatctgaagattgtaaaattgtttatacttaaatatatttacgccagagcatcctaagctggtcactagcttgttaccggtttatatttttatccacggtggtggatattttgctggatgttcaagccgattgctctacggaccagaaaatttcatggaacatgatgtcattttagtcacgattaattacagactcggtgtcttagaatgttccggaaattggggaataaaggatcagatcttggctattaagtggattaaagacaacataaggtcttttggtggtgatgatggaagaatcactgtgggaggtcaaagttctggtgctgcaagtgttaatttacttttgctagtaccacaggcgagaggattatttcaaaatgcaattatgcaaagtggttccatcttatgtccatggtccaatcaaacagattcaagagaaattgcattcactttaggaatattaatgggaattgaaacaaatagtagtaaggaacttatgagacaactaagactagttgatcaaaaaagactaaccaagtccatagaacaatttcttatcttacaactagctcgtatgcccgtaaaaggtttgccttttactccagttgttgagcagcctcacgaagatgccatactgaccaattatacctatgacctattaagagccg

SEQ ID NO: 179 - DNA, 1285 bp, Rhynchophorus ferrugineus
aatgcaatagaaaaattcgaggttgcacatctctactgtcactttaaatcgataatgacgtttaaaggcatgtttttgaaatcaccctatactaattatggttttttgttgcaaaatgagataaactaatctgtatttgtgtgtcaaattaaaattttatcgaattatttatacaggaacgtagcgaacaatcaaaatattgcatatcatgttgtttttagaaggcgcctttcaaggctagtgttcagtgcggagtatatacgtgaacagaaaatggaaaagcaaatagcagttcatcctatggctgaaaggccgactgctgcatggaaggaaatcagtaagcaacagaaaatatataaactgaacgttaaaataccgcaaaaaccggtcgaaccgagcaagcttcggtttgtatgtatgagcgatacgcattctttgattcggaatatcatgttcgatataccagacggggacgtatttattcacgctggggacttcacgaaatgcgggcaaaaagacgaggtcattgcgtttaacaaatggctaggaggattaccccataaatacaaaatagtaatagccggaaaccatgaactgagctttgatgaaaaattcaccaactcctttaaaaaaaagatcgagtccaagcctaaggatatcacagatgaagtgccccattatggaaaaaccaaagacaacataagtgatgctgttaacactgccaatattaggcagtatttaactaattgtgtgtatcttgaagattctggcatagatatttgtggaattaaaatatatggaacaccatggcaaccggaatttggtaattgggcatttaatctgccaagaggtgaagaatgtctatctaaatggaatctgataccagttggtattgatgtactgataacacatacacctcctttggggcatggtgacttggtttgttctggagtgagggcagggtgtacagaactgttatcaactgtacagcaccgagtacagccaaagtatcatgtctttggtcatatacatgaaggatacggagtaacctcagatggaaaaataatattcatcaatgcatcaacttgcgacatcaattacatccccaacaatctacctgtggtatttgatataccaatacccccgagtcatattaaaaatttgtaaaaaaacttattgttttaagttatttaatttaattctcccatttttgtattgtatttatttgtatatttttttctagaggtcagattgttgccaaataaacaaataaattaaaaaggat

SEQ ID NO: 180 - DNA, 1465 bp, Rhynchophorus ferrugineus
ctacattttgaagatgatcctgacccctatagaatttggcgccttagtattgggattaattgtgatatgggtttccatttccctctatagactgaggcctatacttaactttgccaaaaactacaagggatataaattttaccctgtattaggaaattatttgacactatggaaaagagatttatacaaggttcacttacagacaacaaaagaattggggctgccttgtaacctgtggtttggtcataattattattatttaacggatgatttggacgtcatcaaggtaatcctaaaccatcccgctacaatagataaagggaaactatacgatcaactggaaattgtatttggggactctttactcttagtttcgggcgatacgtggaaggacaagcggaaattcttttcaaaaagtttcacccagtccaaattgaccggtttcgtccatcatttttaccagaacagtatcgttttgttggactgtctgaagaatagcggtgacggggacattttccatgtgatgggacgatatacgttcgattcattttgtgattcattcttgggaaagaactatgggttacagactaacgctaaaaataagtttatagaacggatagatgaattacaggcgttcgctggtaaccacttcttgatacccgtgtctttctatttaccaatcagactgatatgcatcctggggtctgggacgaggattttgaagacggtcaatgaattaaagcagtttattaaaaggataatcgataacaagaaagatgaactggcgcaaaatccagtggttgacaatcaattatcctttgttgacatcatgatgagcgacaatcaaaacctgtttcccccggagatgatccagaacgaattcttcttatttgctaccgcggccacagatacgatagcaaacacgtcctcatatattatgattttgttggggatctatccagacatacaggaaaaagtgtatgaagaaatcattactgaaattggcaaggacaagcctattgtcccggaggacctgaacaaactgaaatatattgaacgagttatgaatgaatccatgaggattatcccagcagtacctatcattgtcagatacacaactgaagatattccagtgggtagtatagttattccaaaagacgtgaacgtatctataagtacaatcaatgtacatcgtaatgaaaaatactggcccaatccaatgaaatttgatccggaccggtttctgccagaggaagtcgctaaaaggaacccatactgctacctaccgttttccttgggggctagaaattgcattggaaaaaattatgccctattatctttgaaagtcgtcatagccaacgtggttagaaactacaagataacaacaaagtacaaatctatagaagaggtgccgctaaggagctatataacaatgagagcagctatctctcctgacctacatttc

SEQ ID NO: 181 - DNA, 664 bp, Rhynchophorus ferrugineus
cgctatgaaacacggagttgataagcttacagatctatctgaacagcagttgatcgactgttctaccaatgagtccggctgcggtggaggttatatgtctagagctattttggatttaaagaactctcaaaaaggtgttatggcagcggctgactatccatttgttggatctgatggcgattgccagtatgaccaaagcaaagtggttgtcaatatcacggactgtgtggactacaccaaaacaccagaagaggacatcaaagctattttggtttccaatggaccactagtaattggtttagctggaggacctttacagacatatacaaacggggtttttaaacattgtgatgctgacgctcatatcaaccacgctcttttattggtcggatatggtatagataatgatactaaagacccctattggcttataaaaaattcatgggggacgatatatggagaaaatggttatgttcggttgcaaagaggaaatccagactgcagggttggagaaaatcaattgatatcagcacaagtggcataattttattatgcaattgaaattaaatacacaggtgctttgtatttaattaagtctatcctatctaaaaatccatcatcatatataatcaaaattaaaatcaaaaattattttttcggcaaa

SEQ ID NO: 182 - DNA, 1887 bp, Rhynchophorus ferrugineus
cggttattgcgctgagctttgttggaatttgatttgcgaggccgtagaaaatggccggtaaaaacaatattctatcacgaaaaagcgtttggtaccaatgccgtagctatgtttccacacagccatttaaaaaagcagttgctgcgcaacaagttactgtcaacggtatcaacactaaagatatttactataagaagatcggcaataaacttgaaaacgatgacaaaccagctggatggaatgaggcaaaaccattttccatgataccaggacctaaaccaattccaattttgggaaatatatggagattttttccgggcattggagaatatcataatttagggattgtcgatttgcataaaaaaataactgaaacctatggtgaaatagcctatttttcgggtatatttggaaagaaaccaatggtattttgctacaatcccgatgcaatggaaacgatttccaggaacgaaggtgcgtggccagttagatacggaatgaatgccttcgtttattatcagaaaaatatacgtaaagatgtgtttcaagggatcggtggagttctttctacacaaggggaggaatggttcaaaattaggtcggctgtgaataaaatcctgatgcaaccacgtacagctgaaatgtatgtgggcagtatggataatgtggcgaatactctggttgataatattcgatatttttcaagagcagatcctgacaatctaatgcccagtgattttcaaaatgaattatttaaatggacaatggaatcgatggcagttatagcgtataataaacgaattggtgttttagatcgaaatttggatgtaaactccaaacaacaacagttcattaactctgtattaacaatgttcgatatgtcttacaaaatggatgtcttgccgtcgttatggccatatatttcaactcgaaattggaggaaatttgtgaacatcatggacactctcacagagttaaatcaaaagtttatcaaagaatgtctggaatcgatcaatccagactcaaacattcccgaccatgagagaagtgttcttgagagattgcttaaaacagatcgtcgaattgccataacaatgactaatgatatgctcattgcgggaatcgatacgaccggtaagaccatggcttctgctttatattttctcgcgaaaaatccagaaaagcaagaaaaactacgacaagagctgaaaacttatttaccaaataaagagagtgtggttaatcaagatatgataagggcatcgccttatttgaaggctgttatcaaagaaaccacaaggttggcacctatagccattggaaatctgcggtctactgtgaaggatttagtgttgagtggatatcaaataccaaaagatactgaagttgtctccatcaacatattgtcgtcgatagatgacaaatattttcttaaagctcaggaattcgtgccggaaagatggcttcgtactactgcggatgagttttctcataagaacgttcacccctttgcttccgttccgtttggtttcggtcctagatcatgtataggaaagcgacttgcaaatttggaactggaagttggcttagcaaaaatgataaggaattttcaaatttcctggccacatgctgatgctaagttcggtgcaactttattgtatggtattcaatctcccttaagattcaaagttgttgaagttgataattaatatcgaattctgatttatttctgttagtgttagttattactggaggacttcgttaatagaaataaagccatgaaaactaaaatacacggcaattgtcgtataatttataaacaatattcaaagttatatataagagtggtttggtgaatcctgtaatgttaacaatctttatggaagc

SEQ ID NO: 183 - DNA, 1319 bp, Rhynchophorus ferrugineus
caccactatatatgaaagcagtaaaattttcctaaaaatctccaaatactatcgctactattcttgatccaaaaactccattaataaattggctacctcaagctttcgattaacgtattgtacatttactagtctatgctcgtaaataataatgcattatattttcgttgtcattagatcactagggtgtcgttgatagttttatagtttggttatttgatccaggtctacttttgttagcaaatttaattatttcaaaatatcacggtacactgttcttacaccttaacaaaatgatgtctaatttcttcttctctgatgctctgaatttcacattcttcaacttttaccctcaacaaattctagcaacatcttagcagttactacagcttttgctactattcttgatggacaaacctcattaatgacttgactacttccaatacaacaagaatcattttcttctctgttcttgttatcattaaattttggcgtatgttgattccaattcgacgtcgttaaaaatgatgttgtagcaatattcgtccggtcggtcggtcggaatgtgtggctgtcgatacgattgtttgtctgaacactcactactattttgtggaaggaatttgcacgagaactgaaaacactggttgaagaaatacttgtttatttcgatttaaagtgatacttgtagtcgacgggagaatggacagtatattgggttaggtaaaggaagtacggtagcactgtggaagtgatactgttacaagttggtagagagaagaaaagagagagagacgtcgtcatgatgacctttaatagccgggaaccgtagggtgccaatccaccagcgttgccaacctttgaacttgctgtaggtgaatgcgtggtggtttaaagggttgtagcggtcgctattccgcgcaacactattcctgattttcttgtgagacaattggaaaatatcattgtcttgcaatccttccagatcatctttacaacactgcggttgtggatatactaattagttattctattaactattttcagtagtagggccattttaaactcgtggtagtgacgcgttcttgtaacggtagtatgggcgatattttctggaagtgttctataagatgctttaaagtaataataagatagtttttaatacatatgtattgggtttcctcagtgtcgatgatccatcagcgaacgctacaggcaatgcgggattgaaagaccaatgtttggccttgcgttgggtacaaagaaacatcagtcacttcaatggggacccagaaaatgtgacacttttcggccaaagc

SEQ ID NO: 184 - DNA, 1282 bp, Rhynchophorus ferrugineus
tttaacactatttgttgacaagtaacattttttagttatggcacgaactgtaatacgggcagttatgttgtttgctgtattgaacaatagttcagtatatactcaattgtttccacctaatccaataaatttggacttgaaccctataactatagcacagcaatggatgaaatttaagagagaaaatggcaaaatgtacaatgatcttgaagagaaacttagatttgatatatttaccgagaatattaaaaaaatagtgatgcataatcagaaatactttaacggtctaattcactatcacatcggtatcaatcaattttcggacctgaccaaaaatgagtttgtaaagaatattttaaaattaaatacaccaagtggtcactcatacagaaataaaagatccgccagacaaaagagacaagcattaccggaaatagattggcgacaaagaggtgcagtgaccgaagtaaaaaaccaaaaatcttgcggttcttgttggagcttcagtgcaataggttcattggagagtcagttctttttaaaaacaggccatttagtgtcacttagtgaacaaaacttaatggattgtgctgtagaccaaacaaacagagcttgttcaggaggatggatgtccaatgcatatgactatctcaaaaatcattgggtgacctctgaaaatatttatccctaccgtggacaacaacaagaatgtcaacttctgagtaattcctatcaagtatccattaaagattattatacaattccaccaaacgaagagtctctgaaacaagcagtgtcgaacatcggccctatatctggggcaatggacgcgtcaaatcttcaattttatgctggtggagttttcagggatgacgactgcgacacctccggttacgtaaatcacggaatactggtcgttggctacggaaacgaagctggaagggactattggctaataaaaaactcttgggggaaagaatggggagaagggggatatttcaaattgatcagaaatagaaataatgagtgcaatattgccacttatggcatgtaccctattttataagaatattccaatacggctatactttattttaattttttaaaagataaataaactgattttcctatatttacatttgttttgagatatttttacatcactgcttaatcatcagcgtctcggctaaacatttctttcggcgctatgtttaaatcataatgtcttccttcgctcgccgtctccgtcataatggcagatattttgatttgaaaggctttg

SEQ ID NO: 185 - DNA, 2005 bp, Rhynchophorus ferrugineus
cagagatgcgcgacggggttgtagtatctcgtagttggcgggggggcgcgtagaattccgaaatgtcgcgctttggttgtgttacaaaatgttctggttctccttacggtcctccgatcacgctgtctataaaatttggcgctgtaactcgcgctatcattcctcgtttaacaggggtgccatagagaggtagttgttttaggaattcttggatgccggttttattttgaatatattcagtgttaatatccggatttcttaggtcctcatcatgtcgggccacgtccccctcaaagcgatccgcctattacaaaaggccacgcccgtgcgcgcaatccacgccctccagatccggacctactcgacctcgcctgaccagagtcccaacccccgagggcggacgttctccacggctgtcgacatcctaccggaggacgcgtacgagaccctgtgggacgcggacgacgtcgtgcaaccgtacagcgccatccccggacctcgggagttgcccatcatcgggaatgcctggagattcgccccgataatcggtcagtataagatccaggacctggataaggtcatgtggtcgctgtacgaggactacgggcgtatagtcaaggtaggcgggttgatcgggcatccggatcttttgttcgtcttcaacggagatgatattcgaaaggtgttccgtagggaagaggcgatgcctcaccgtccgtccatgccctcactgcattactacaagcagaaactgcacaagggcttttttcacggcaacgaaggcgttatcggagtgcacggaccgaagtgggacgccttcaggaaacaggtacagcaggtcctgctgcagcccgcgacggccaaaaaatacgtcgaacctctggacgtcatcgccgacgactttctcggcctcatggagcactccctggaccacaacgacgagctgcccgacaatttcctctccgagatctacaagtgggccttggaatccgtcgccagggtggctctgaacacccgcctgggatgcctggacgtcgaactgccgcgcgagtccgagtcccagaggatcatcgactcgatcaacacgttcttctggaacgtcgccgaggtcgagctcaaaatgcccgtgtggagggtgtaccagaacaaggcgttcaggaaatacatcggggccttggacgacttcaagacattgtgcctgaagtacatcatgcagaccgtggaggccatgcagtacaagaactacgaccacgccaaagaggaggatatctcgatagtggagaggatgctactgaagactgataaccctaaactggcggccgttctggccctggacctgctgctagtgggcgtcgacacgacgtccattgctctggcgtccacggtgtatcaattgagtcaaaacccggccaaacaacaaaaactgttcgaggaactgagaagagccatgccaaggcccgattccaagatcgatgtaaagaccttggaacaagtaccgtatttaaaagcctgtatcaaagaaactttaagaatgtatcctgtgataattggtaacggaagatgtctccaatctgacacagttctcgcgggatatcacgtgcccaaagggactcacgttatcttccctcacttagtcgtaagtaatatagacgattatttcaaagaaccagaacgatttgtgcctgaacggtgggtaaaacacaactccagttcgaaatgccctcataatcaagaaaaagcgcaccctttcgtgtcgcttccgtttggatacgggcgtcgttcttgcttagggcgtcgattcgccgaaatagagttatatatcatgttggccaagattttcaggaaatatcaagtaaacttcaactacgggcctctgacgtacaagattacccccacttacgtgccggaacaacccctaaagtttaaactaacccctagaactgattgattacactaacccagagtattattaaaagaaatatatttttttctttatagcgtcgtg

SEQ ID NO: 186 - DNA, 1203 bp, Rhynchophorus ferrugineus
ctcaaattccgcgtgtaccgtgaattattgtaagacctttgtgtgatatgcgataacactttaagagtctgtcgaataaaacgaacataaactagtaaaaatgctcccgaaacaaaatacaagaatgttgctgctcgcctactggttttcaacgatgttgatcgatctatcgatgcaagaagaacttaatgaaactcaatatggaactcctgaatatatcataccttgctataaagccgacccaaacatcaactcatgcctacagaaaactttcaatcatctccggccatttttagtgaacggattaccagatattaacgttcctaccatagatccctttaaactggacaagattatcatcgaaaatggccaaggcccacttaaagttaaagcatctttcttcaatgtcacagcagttggagcacaaaattatacaatagagaggataaatgccgacgtagacaattatattatcgagatcggattcaaattccctagaatggaccttaggggaaagtatgacgtcaacggtaacgttctcctgttcccagtacgatccaaaggagatttttgggcgatattcctcgaagtggatgcagctacgaagataatcggcaaagaatttaccaaagacaatgttcgttacatgaaggtagacaagatgctggtcgattttcgattgaagaagagtcgcttcagaattagggatattgtaaatcatggaaacgttataggagaagcaatgaacaacttcctaaacacaaattccgaagagatcattagcgaaatgaagccggcagctaaagcttcaatagccaaacactttaaaggatttttaaacgaagcttttacacgattaccacttaaagtttggttacctgacgcctagtcctaatccagttaccaacgtttgatattttaagttatttatattatagaaaaagcttacagcttagtgcggtaagagtaaatttgtttgagaatttctagagtgaatatttgcctttatccgctatttatgtgaagtaaatgggttaggactaaaggtgatccacggtacaagttttcttgcatctttttcaggaggaaaaaaatgcacttaatgtaaggattttacaaatagtttagggttgaaaattgtgatacaggtatagattatattttatttttatacgaaatacgaaataaaataattaaaagtaa

SEQ ID NO: 187 - DNA, 988 bp, Rhynchophorus ferrugineus
tgcctaatctgattaaacaatttttaatcacattactgaacatatccccgggaataatggtaagaaatataaactctctcgcagataaatatgctattggaaagagaatacagcatttcttcactggtagcaatcatttttctgaagataactttacggtagttatgcagtatctgaatgacgatgaatattactggccaatacagaagggattaacatacatatctaggaaaaatcctgtgtatttttacctcttttcatatgaaggcaacatgggacttactggtttggaatctataacgaatataacggaaaaagtagcaaaaggaacttatcatactgaagagctgttttatttattttggggctacttttcgaaagacgcgtcaaaagaggatttaactatatccaagaaaatgctaatgatatggaccaattttattaaatttggaactcctacacctattcgtcaagaaggcctggataatattatttggcccattttaaaggataattctctttatgtgaaaatagacacgaacttgacagttattaatgggactttcggtgaattaaattacaacttttgggataacatatataaagaatattcagcagaacctttcccatccagtaaagctgatatctagaacctatataaatctttaactatagtcagttcaataaaacggtgaactcacgccatctatatgtatgacgtcaaaacttcgctatgttgccgcatcaactttgaatataaaagtctaatctaaataaaataattgaaaaaaatgttatactatataatttattttattattgtgatacatctaatgcatatattagctccttcctattcgaaataactgattagagaggtaatgtgttggttctctaatggttttctaatggcttcggcattttcaatcagcaaaccccaaaacaacgtttgccggtgtacaacctataattattatcactaatgttt

SEQ ID NO: 188 - DNA, 292 bp, Rhynchophorus ferrugineus
ttcatgttagacacatgtttgtgatcaactttacgcaattgctaatcattttatcgattgcttggtaaaacaaatgtaccatcttgtttaaataatgcacaactatttgagtgtcgttctcgtatctgtgctatttagtataagtgctattgatttggatgaaaatctacaagttgaaacgaagaatggtatcgtacaaggactcagagaacaaactcaatccggtcgcatgttttacagtttttctggtataccttttgcccaacctcctattggtgacttgagatggcga

SEQ ID NO: 189 - DNA, 948 bp, Rhynchophorus ferrugineus
tttaacatccagcgagataccattaaaaagcgcacctttctcagacgagtttgttttgtaccagttcgtatttttaattgaaacgaaaaaaaaaaaccgtgtcaatatgagattctgtgttctcgcctgtctttggctcagttactgttgtttcgtccagtgtgccaaattaccgtcagcttggggcagatgtcacaaatcagatgccggtttttcggaatgtataagggaaaacatcgaaatagcggtatctacattgaataagcctatctcggagctaaattccggagctctggaccctctggatataccggagctttacatcggtgaaggaaccggaccagtcaacgtagctcagcattttaaaaatgtaaaactcttcggcatctccaacgtcaaagtgttgaattcatcggtaaatttcaaagataaatatattcaatctgtaacagtcagtccgcagttagtactaaagggtgattacgacttgaagggtcagatactgctattgccagtctatgggaatggaaaatgtacagtgactttgtctgatgttttaatcaaccacaaaatagtgtgggaaaacatcgagaaaaaaggaaaggtgttcatgaagtgtgtggactataagattactctaaaacctggtaaggtatcttaccagttcgataacttatttgacggtcaaaaggaactaggagataacattaacaaagtattgaacgaatcgtgggaagaggtctttaatgatgtcagagatggttacgagaaaagcttgggaatcatctttaatgacctggccaaccggatattatccaaagttccggaaaaagaaattttcttagaatagaatatttaaaacagattgaatgtgatacaagtctgcaaactatcattttaagacatatattttttgatatatatttaatattatacaaatataaaaac

SEQ ID NO: 190 - DNA, 322 bp, Rhynchophorus ferrugineus
actgaatggttatcaaataccaaaaggtactgaagtaatttctattaacattttaccgtcgagagacgacaaatatttcatggatgccaacgaatttataccagagagatggctacgaagtactacagatgaatattcgtccaaaaacgttcatccatttgcttcgtttccattcggtcttggaccacggtcttgtgtaggcaaacgcttggcgaacatggagctacaagttggtgtagcaaagataataagaaactttcagttctcgtggcctcatcctgatgcccaattcggagcaaccttattatatggtattcaaaca

SEQ ID NO: 191 - DNA, 260 bp, Rhynchophorus ferrugineus
actgaatggttatcaaataccaaagggtactgaagtaatttctattaacattttaccgtcgagagacaacaaatatttcatggatgccaatgaatttataccagagagatggctacgaagtactacagatgaatattcgtccaaaaatgttcatccatttgcctcgtttccatttggtcttggaccacggtcttgtgtaggcaaacgcttggcgaacatggagctacaagttggtgtagcaaagataataagaaactttc

SEQ ID NO: 192 - DNA, 745 bp, Rhynchophorus ferrugineus
ttgtctcatttaacatcttatgttcaaccaatttacgtatattacatgcatgatataggatttaatataaacactacagatggttctgtttcaactgatttactgttattatttggtccgtctttattaaaaatgataggaagaaggaggtttgtagataatgaagcaattttaagtgccgatttaaaaaaaatgtggaaacattttataatttttgggaatcctactccaggtaacgacaaagtaaaacaatggagaaaatttagtcctatagataaatacgtagaacaatttcatcaatctgaagtagaaaacattttagagcgaacggaaagtgttacattttggaatgtgcttttaccaaaattctcaaaataccatacgacattttctacacgaaaagaactacaaaatattcctgatgcaacaagaaacttccggcatgccctatatacgttagtaggtgttattgtagcacttttggttttattaattatatgtattattcttttaaaaagaaaaagccatgaaagagaacgtgaatttcacataggctactagaatcttaaatacatgtatatacaaattaatataaacttttctcctcaattgtatgcaattaaacatataaggaataagtgtagggtgtatgttcagttgcatatatatacaaaatgtctaaatcttattgcactgtattattgttatgcatctattataaaagtttgaggttatcgcgatcgga

SEQ ID NO: 193 - DNA, 1226 bp, Rhynchophorus ferrugineus
ctcagaatgaaatactttctagtgttgtgtttctgtgcagttgtgtacagcacttctgtaacagttgttataaatggcaaggaaaagacctattattacattgacaaggccgagcagcttttcgagcagttcatcgcaaagtttgagagaaactacgcatctgaagaggaaaagctgatgagatttgaaatattcaagaagtcgcttcaagtcatcaatgacagaaacatgaagctagattcaattcatggtataactgaatttactgatctgacccctgaagaatttgaacaaagacatccccctggtttgttgccgcaagagcaggcaattccttgtcaagtagtacaattcaataagctttcttatttagaagtccccagcagactcgattggcgtgaacgtaacgttattacgcctgtaaaatctcagtcatcatgcggctcttgctgggcacacagcatcatcggttgtttagaatcacaatgggcaattcagcatggacagttgctggatctttcagaacagcaattagtagattgtgaaccaactaacagagggtgtgggggaggtggattgacctcgaatggtggagtataccttatggaaaatggtgctatgttagaaagggattatccgtatgtaaatgctaaaatgaattgtacatacgactctagcaaagtgtatgcaaaaccttcccaatgtattaacttcggaggtacttctgagattgatcttatggcgattcttaaccagtatgggcctatatccgtatctattgatgcgacagcactgtcgaatccgcaaaatcaattttacaatgatggttttatatcaaactgtgtatctaatcactgttcacacgcggtgttgcttataggatataatacagctagcgcagaaggcccgtactggattctgaaaaattcctggggtgcaaattggggtgatcagggatttttcaagataccaatgggttcgcaagcttgtatgatttctcagtgcatgatgaccggtctacaagtctagaatcctttgtgttatggtgggattaataactacaccatactcgtataagaactgagatttcacttccttgtgatatttagaattattcacaaaaacctcgttctcaccataacgaacataaaattacgcaacctggaaatacatttcagtgattcatttataaattttatgtataatatatattaataaatctgtgc

SEQ ID NO: 194 - DNA, 346 bp, Rhynchophorus ferrugineus
gtttcacggcaaggaaatcacggatttcttcattaacctcgtcaagagtactcttaagtaccgtcaggacaataaaatagttcggaaagacttcctacaattattaatacaaaacgagtccatgactgaggacgagatcatcgcgcagtgttttgttttcttccaagccggctttgaaacatcctcaacagctatgacttacgctttgttcgaattagccagcaatcagcacattcagaacaaattacgagaggaaatcgaagaagttttgaagaagttcaacggaaacgtaacatacgacgctataattcaaatgaaatatctagacatggtggttaatggtaag

SEQ ID NO: 195 - DNA, 498 bp, Rhynchophorus ferrugineus
gatataactaaattccgccaactgaaaagtttaaccaatgaagatatcacgtcacaagctgtaatcttcttttttggtggatttgatactatatcaacggccatgtgttttggatcttatgagttggcgatcaaccaagacattcaggataggctgaggaatgaaatcaaaagaactttcgaagaaaataatggtcaaattacgtacgatgtattgttaaagatgaagtatttagatatggtggtatctgagatcttgcgaaagtggccaccagtatctagaacagatcgtgtttgcaccaagccctacatcatcgaaaataaatctcctggggaacccaagctttatatcgatagcggcattaccatttccataccaatcatgggctttcatagagatccactttattatccggatccagaaaagttcgatcctgaacgattcgaccaagcggataaaattatggattatccgtactttccttttggatgcggtccc

SEQ ID NO: 196 - DNA, 3148 bp, Rhynchophorus ferrugineus
agaaaacgctgcggcacttcgtgctggagtacccgtacacggaggagaacatcacgcagcttatcgagattttccgcaaacatcgacattttaggttatcgccaaaagtggtgggcgacatactgaggagatcgatcactgccctgcggaaactgccgaacataaacgtcgcctccacggccctctccaaacagataacaatctgcggagacctgcacggaaaatttgatgatctcctggttattttacataaaaacggtcttccttccgccgaaaatccgtacattttcaacggcgacttcgtggacagaggcaagcggggcctggaagtcatcctgattttactgttgtgcttcatcacattcccgggaggagtatatctgaacaggggcaatcacgaggaccacataatgaatcaaagatatggtttcattcgcgaggtccaatccaaatacagaaaaaaccacgagagactgctgaaactgttcgagggcgtttaccgatggctgcccttggggaccatcatcaacaataaagttctggtggtgcacgggggtatatcggacacgacggatctggagatgatacgaagtttggaacgcgaaaagtacgtatcgttattgcggcccccgctgtgcgagagttctgcgccaggtgccgatgccattaataaagtcgagtggaaacaagtgttcgatatactatggtccgatcctcaagataccagaggatgtataccgaacagtctgagaggagctggtacttacttcggacctgatgttaccaagaaatttctggaggaaaatcgtctgtctttcattgtcaggtcgcacgaatgcaaaccggacgggtatgaaatgtgccacgataatttgattataacgatattttcggcttccaactactacgaggtgggttccaacaacggggcctacgtcaaactcggcggattgaatttggagccgcactttgtacagtacatggccaacgcgggccggaggaaattgaatttctaccagcggatgggactggtggagtcgggcgccaccagggagttgcaggcgcagatcctgaacaaccgggacaaaatcgaggaggaattcgttaagttggatccggaaaatacaggttcgatatccatcacgcagtggtgcataactctggagggttgcacgggattgcagatcccgtggaggctcctcaaggagaaactggtcaccatcgatcccgacaccaaaatggtacagtaccagacgacgttcgacatcaagagcggtcgcctcaattccgttcaaggcgccagcacagttgtagagactctctatcggaacaagagcagcttggaagccatattccggattatcgataaagataactcaggttacatcagtctggacgagttagccgacgcctgcaacttgataaaggaacacatgccctgtaacatgactgaagaacagctgtcggagatttgtcgaatgatggacatcaacaaggacggcctggtcgatcttaacgagttcctcgagacattccggatggtggacccggaaagcaaaaagaagaacatgcccagcagtccggagaacatccacttgaccaatccgatccgagagcggatatccagcttgaaacccgacaacaacaccttaacagtggacgcggccaggaaggatattttcgaggaggcggccaggaacatcgagggaggcgacgatcccatctcgctgacggcgcaggtccataattgcgtgtcgaagaacgaggatgagcaccataacgggctagtgtcgtcgccggtacttagcagcaggagaggatctcaaatctaatttttcgatggaacatatcagcaagttattttatattgtccattttctgtctgaaacatcaaaggactgtgtttagcttcactgaccattcttgagaaaccaaacttccgcaataacacatgaaataaacgccgactgatggacttctggttctaaaatggtaaaaggttaccgctgactcgttaaaaggctttcgtttcaacaacttatacgcttatcgttcttcccttatattacgatctattcccgaacaaaaaattaaataaaatacataaataaataaggaaaatacgggatctgcctcaaaagttttcaaagatgttttccagacaattattgcctggagtatcaaccctggaaggctttctgaaaaatagtggatgaaaccgcttaatagcctcaacgttttttacagcatcagtttctagatgtggagactcatgtaggttcggtttgatgcaatggaataaaatagaatcagtcgggactataaggcctatgtactatgtacttcgtgagaagtttgttaacaacaaggactgtctacgatagtcaagagatgcccacatagactcctgggtgtcttgaaatttttacatcactcatatagagctgttttgccatttggcttattatataattcattagacgcttcctgtttttgtataaacattacccttacttgtccgttgctcagaagtagtcactgaacaaccactattggattctttcgcctaataattcagaaagccttcgggacagactccgtataatataattaagttacatggtatagactagaatgtatatatcgatgttacactaaataatcaccactagaacgcttttgcaccatcaagaaaaacgtactcgatatttctacgtgttctattccatataaatattacgatatttcaaaaatgtagacttgtagcatatattttgcaaggcggctgtgataaattatcccggaaacatttgaacgactcaaattctaatattgggcctgagaaaaagttcgtcacgttttttaaaaatatttcttacatgaaaatgaatttattctactgtcggacgtaatatgtcactcgaaataatactcaaaacgtaaggagagcccagcaaaaaaaccgtgaacttttttccaggcgcaatattataaacggctttggatgtgttaaaaggcaactttttcaagtctttggtgtataactggttgcaaaatatattctacattgtacataataatagaaaataaaaacaagataatttaccgcataatatcgttaagtaaatgaaaatacagtagatattgt

SEQ ID NO: 197 - DNA, 506 bp, Rhynchophorus ferrugineus
ccaacctcgaggaattggcgggaaaactgggcttggaagccacctgtgccctggttctcggaagacgtatgggttttctgatcgaagaccgcgtctgccccgtcgcccagaggctagcggacaccgttaaggttaacttcgccgcctgtcgggacacgtacttcggcctgccgttttggaaatggttccccaccaggtcctaccgtcacctgtgcgagagcgaggcggctatctacgaactggcgtcggaactcatacggaccgccgacgattccacgaaggagagcgccgtattccagtcggttctcaacgccgacatcgacgaaagagagaagaaatccgccatagtcgattttctagccgcgggcatccacaccttgaagaacagtctcctgttcctgctgtatcaagtagctctcaatccggaatgccaagagaaaatcattcaggatgattcaaaggcttacttgaaggcatgctccatggagaccttccgcatcacaccc

SEQ ID NO: 198 - DNA, 692 bp, Rhynchophorus ferrugineus
aataaggttgattggaggacaaaagacgtgataaccagagttaaaagtcaggatgattgtgggtcttgttgggctttttctgtcattgaaactatggagtctatgaatgctataaaaaataaggaattgaaagagcttagtgtacaacagtcagtagattgttctagtgagaataggggttgtaatgggggtgatatatgtagtttagctcattggctcttgagtaatcaggttcctgtggttttggaggaagaatatccgtacaatgcaagatttcaaatgtgccgggaacttaataaatcaggaatatatctgtctaaatattcttgcggcagtttagtaggtgctgaagatgtaatactgaattatttagcatttaaaggccctttagcagttgctttgaacattcatacttggcaatattacgtgggtggtacaatacagttccattgttccagcaatgtcaattccatgattcatagcgcgcaaatagtcggctatgaccttacagccgccgtcccatattatattgtaaggaattcctggggacacgattatggagactcaggatacgtttacattgcctacggaaaaaatatgtgcggaatcgccaacgaagttttagtattggatgtctgaatattcaaacaaatttcctcaatactgtataataaatcattttctattctcaa

SEQ ID NO: 199 - DNA, 665 bp, Rhynchophorus ferrugineus
tatgtgaaagccagtgtcaagattcctgggacgcattgcagtggttcttgggatgttgcagaaaagcaattaccgaaggagttcctgctgttcctgtacctaaacatgatcctttggtaatcgataattttacatatgaatataattctgtccttttcaatgcggatatagctataactaacaacgttcttcacaatttactgaatctaagctggccagtactgaatattacagattttactgatcccgcaagaaaccttatacactatgatatatactggcccttgttgaattttactggagattacgaggtggattataaagtaccattgttaccagttgttaaatatagtggatcttacaatattcttctgcatcatgttgactggtggggaatttttgattttgttcaacctggccaggaaaatgtcacaatgcaagtcgatcaattcacgcttagttcaaaaattgtagatgttgacgttgaactgactggattctttggagatgatgcggttgccttggtccttaaggaagcgattaaatatctgttcaataattttcccagttcagctgctgagtttttgagagtgaaacgattcaacgaattctggggtgagcaccccgaaagaatcgatgctgttttcaatttctgcttggagaac

SEQ ID NO: 200 - DNA, 505 bp, Rhynchophorus ferrugineus
aaagaatatatgagcattaaggattacaattttgatgcatctacgaaaaaaggcgcacatttctactttgataatctgttcaatggccggaaagatttagccgacacagttctgaggttcgcaaatgaaaactcaatagaagtgcttgatggattccagaagccagctctcactgcaacctataacaagttcattaaaaatgtcaacaaataccttaaagcaatgcctatggaacatttgttcgcagagtagctatacgaaaatgcagtcaacaacaattttaggtcacaaaaaataaactgtctactggtgaaactactcgtgaatttgagcaactttttgtatgagaatttgagaactttttgtatgtcttaattcgatcgaaaaataaatcagctgttccttaaattttgggcgagtaggtgttgtaaaatagtctgtaatcattcctttgatcacgcaatcgattatttttatgtattacttataatcgagtattttttat

SEQ ID NO: 201 - DNA, 373 bp, Rhynchophorus ferrugineus
ttatacaaaaggatttcagttatttccaagggcgaggtttgtacacgcacaagaatgataccctttcgcaaaatatgtttcgactggtgggtgacccttggaaaaggttgagggtgaagttaaccccgacgttcacctccagtaaaatgaagatgatgttcggcaccgtccaggagaaagagaagcgtttgaacgacgtgatggaagaatatgctgaggatggcggtacctttgaggtaaatgacgtcactcgtcgctttaccagcgacatcatcggatcctgcgcgtttggtatcgaatctgattctctgcaatgccctaagaatgagttaagagaatatggagacaaagtgaacgatcctaaattactgag

SEQ ID NO: 202 - DNA, 489 bp, Rhynchophorus ferrugineus
cgcagaagatgaagtcgtagtgaagacggcaaagggacttattaaaggcttttcacaacaaactagaaatggagtgacgtacagttcgtttttaggcatacgatatgctcaaagccctacagattatttaagattccaaacgcctcaaccaataaatccttgggatggagttttcgatgcaacaaaagagaagggcatgtgcttccaagttgatcaagataacgatcttgaaaccgaagattgcctcttattgaacttatttacaccagttgatctgaggaataactctagtgcgaagttaccggttatgtttttcatacatggtggcgggtttatagaaggaacaggaatattggaatggggagtgggacctatatttttcatggaatatgacgtcattatgatagcgataaactatagattaggtccatttggtaagaataatctataaaaataaaaattaatgttgaacaaagccatgtacatctt

SEQ ID NO: 203 - DNA, 503 bp, Rhynchophorus ferrugineus
tctaacgagtacacggattgggagaagcccagtcagaatccgttgagtgtgcgggacgcgaccctggacgtgttgagtgacggccacaccgtggcgcccctgattcgaataggttatttacattcgctgagtggtggcaaaacgttttttctacattttcagcatcacggaggagaaagagacatgccattgagaggagggacggttcgaggagatgacttgccttatattcttggtctacctctaataaatggaggatcgttctttccacacaactatagtcacagcgacatagcagtgtcaaaaacaatgatacaatacattagcaatttcattacaaagggggacccgaatggtggggctgttccaaatgcactacccactgcaaataaaccacagtcacaggatggcaacagaattccaaacctaccatattgggatacttatgatacaataaatcagttttacttagaattgggaagccgtaccgaaagaagagacca

SEQ ID NO: 204 - DNA, 1396 bp, Rhynchophorus ferrugineus
ggagatttgtttattattggtcatttattggaagttacatgttctctagaacaaatgtttttgttgttaagaagatggagtaaaactgaacacatgaaaccaatgtttattggtaggattggaccttatttgtttctaaatactgcagatccggatatcattgaggatattatatcagcatccaaacatctggaaaaatctactttatacagatttcttgacctttggttaggaaaaggattactaacgagcacaggaaccctgtggcatacaaggaggaaaatacttacgtctgcatttcatttttcgattttgcaaaatttcataagtatatttaacgaaggaggtgataaattggttgaaactataaaacaggactcgaaagattctgttgatgttgtaccgttagtgtctgatgccactctacatggtataaatagtacatcgatgggggctaaaatggaatccatcgaaggtggaattgagtacaagaataatgtgggaaaaattacgtattattctgcctggaggtgtgtaagaccttggttatttaacaacatattttattactactttacgtctaacggacgtaaagaaagacaactcctgcgttcgtcacacgctttcatcgatgacttgatcaaacggagggctgctggtttccaagtttttgacgttgacaacgaaatatcattcggacagggtaggaagaagttggccatgctagacttgctgttgaacgagaaaattaagaacaacgccatagacaaccagggtattagggacgaggttaacacgtttgttttcgagggccacgacaccactgcttctaacttatcttttatgttgatgcttttggcttgccatcgtgatattcaggatcaagtgtacgaagaattacaacatattttgggtccagagttatccagagagcctacatatgccgatttgcaagaaatgaatcttatggaaaggtgcatcaaagaaagtttaaggttgtaccctagtgtcccttttattggacgtatagccagtgaggatattgttacaaaagctggaatcataccgaaaggattatcgattaacattcacatatatgatgtccatagggatcctcaatattggccagacccagagacgtttgatccatctcggtttttaccggagaattgtcggaacaggcatccgtattcgtatatacctttcagtgcgggaccaaggaattgtataggacaacgcttcgctatcttagaaattaagtcgattttatgtaaaatattcaagaactttattttggaaccgattgataccccagaatctctggtactagttcaagagttaactttaagatccgttaatggtataaaagttaaatttgtaccaagaataaataaga

SEQ ID NO: 205 - DNA, 840 bp, Rhynchophorus ferrugineus
actatcgtatccagaacaaggtgattaggaatgacttcatgcatttgctgttgcaactgcgtcagaaaggcttcctcgacgatgagtcaaaaaccgtacaggaaaccggtagaatcacggacgacgatatcgtcgcccagtgcttcttgttcttcgtggctgggtatgatacatctgctagtaccctgtcatatgctttgtatgagctggcacaacaccaagacatacagaacaagatgcgtgaggaaatttgcgaggtactgaaaaaatacaataaccaattgacgtacgatgccttgaaggatctggtttacacagagaaagtgatctgtgaaactctgaggaagtatccagtggttcccaccatcacccgacgatgcaaccaagcgtacaaagtacccggaactgatctcaccatcgagaaaggaactggggttaaaatatcagtttttgccgtacaaagggatccagagtattttccagatccaaataagttcgatccagagcgatttaacgaggaagaaaaggctaaacgccccgaatatacttatttcccgtttggtgacggtccccgggtttgtataggtaaacgttttgccatgatgcaaacgaaggctggtctagtgggcttgctcaagaaccacaagtattcgttcagtactacaacgccgacaaacctgaagttcaagaaagccatcttacttctgcatacctcccataaagtaccactgaccgttcagaagatctcacagtaaataatcatcaaaatcaaaatgtgttcaatataaatttgaaaataaaaattgctagactgaggtttggtaaggtttgacattagga

SEQ ID NO: 206 - DNA, 1799 bp, Rhynchophorus ferrugineus
gtcgagatttcctttaagaaacaagcgtgcgttagcgaactgtctaacatgacccgtattagcatcgcgtttcaatggaatataaagtgtttgtgtatattcatcatattctattgttctttggcaaaagaatatattgttgatattccctatcagggcaaaatcaaaggggaagaactatcgaagtttaggattcaaaaaataatcgcatattatgggatcccctatgctcaaccgccagtgggatccctaagatttgcagctccagtaacagatccattaccctcttgggacaatataaaaaatgataccgattttcaaccatcatgtctacaaggaaaagaggattacaaagaatcggaattaccctttttacagttgcttactgatgttcaatttccatctaatataagtgaagactgtttgtatttaaatatttttgttcctaacttttctccgccatctcagggatttgctacaattatatggatacatccaggaaattttacaactggaatgtcacaaatatggaatccacatactttagtctatcgccaaagagttattatagtgacatttggttggagattaaatataatgggcttttttacaacaatggacggcgaggcttcaggaaattatgggttgatggaccaacaagctgcaatgttatgggtcaagaataatatcaatctgtttggtggaaatgaaaataatatatgtttgatgggttatggaacaggagcaattagcgttggaatacatatgattaattctggatccagaactttatttcataaagccatagttatgagcggaaatatgtttcaattgtcagcagttcgatacccggaagaagataaagagatcatcgacagactagccaaagactttggatgtattcgaaagcctacctctttatttattgattgtttgcgccgcgtagatggtaatcttcttgttcagcaaacatcgaatgtaaattggagacctttgattgataaagatttgagtaactcaacttcaccttttttatctgagcctttgaaagatttttttgatcgagacgaatatgttaaaattccaattttaacaggttatactaatatggagcaagcattagagtttaatgatctagaaaacagctcaacaacttttaatgcggaatcattcaggcagttgttgagcgatttggttagcgatgatattcctaatataaacgtcacggaaaatggctgttcgtataactacgatcacattatcgattctgttgttttcttttatacgcctactgttccgaattataattctgaatcatttaggaaaacagctattgacttaatgcttgaaaaaacctatggttcgtcgacgatttatttagcgtcaaagcttagtaaagaaaatcaaccaacatttgtgtatagatttgatatgaaacctagtactagtgcagtaataaaaaatattccacaatgggttggtgtaccacatctctttgatctcatatacatttggggagttccatattggagaccagatcaagagtgggattatcgagataaacgcatatcagacacaataatgtctttttggactaattttgcaaaattttcaaatcctactcaaggtactacatatcctatcaaatgggaagcgtatactactgaaaaacctggtcttttgatcatcgacaatacctttaatatgagttcgcctgctaatcttaattataaagcctttacattttggaatgagtattatccaaaagttcttgatgtctcgactgaatgttgtggaac

SEQ ID NO: 207 - DNA, 468 bp, Rhynchophorus ferrugineus
ggatcatatataagcgaaggatgtgatggaggactctacgaggacggtttaggatatgtggtggagaatggtcttgataccgaatcagaatattcgtataaagccgttgatcaaagctgcaaagcttcaggatctcctgcagttaaaatttccaagtactatgacgttagtccggacagtgaagatgccatcgccagcttggtagcctccaaaggacctgtgggagttgctatctatgccgaccctatccaactgtacgacagtggtgtgtacacaggtttctgtctggattgggagttcctcattgatcatgcagtcactgtagttggttacggttcagaaaatggagtggattactggattgttagaaattcctggggagctgactggggagaaagcggctattttagactacaacgtggcgtaaataaatgctccgttgctagcgaagcagcatatgtagaagtg

SEQ ID NO: 208 - DNA, 1939 bp, Rhynchophorus ferrugineus
tatcgaagaacaaccagatagcgagggttcatcagtatccggatcgtcttccgatgaagaaggtcctagcgaacggcccaaatcggatatacccgctgaatattggcacatacagaaactggtgaagtatttgaagactggcaatcaaacagctacggttgttgcgctgtgttgtctaaaagatcatgatttaacaactgagattaatcagttagctatccaggaaatcggcggtttggaacttttaatcaacttactggaaaccaaagatctcaaatgcaaactgggagcattgagcgtattgaccgagttatcgcaaaaccaggatatccgccgatgtattgcgaatcttggaggaataaacctcttggtgaagaatctcaccgaaccggccagagacctgcagatattggtagccgagaccatatacaacgtggctcaggtgaagaaagcgaggaaacatatacgccaatgcaacggtataccaaagctagtcgatttcttggactgcaacgagacttatttaaagactcccaaggagcagctggttgagaacgacatcgaactggtggatattgtgaaagctgcagccagagctttgtggtcggtgtcaaaaagtaagaaaaacgtacaggtgatgatgaagagtggctcggtaccgttattagcgaaactattaagatcagtccatatggatgtagtgataccaacgataggaactatatcacaatgtgcaaatgatccaagttatcagttggctatacagaccgaaggcatgatcagagatatagtacgccatttgtcagctgatgaatatccagaattaaggcgattttgcgccgaaaccatcttcaaatgttgcgaaaaagcggcgtcacgtgatatggtacgccaagctggcggattagaccctctggtgaatatggctcgcgatccgaaaaccaaagaagataaaccactactagccgcggttacgggtgccatttggaaaacggccatcagttcggaaaacgtagaaaggttcgaccaattgaaaacggttgaggtcttggtgaaacttctggagaatgtagaagaagatgaaagagtgctcagtaacgtcgtgggtgctcttggtgaatgtctcaaattcgagcacaatcggagcacgttacgacgtgcagatggtataccacatctggttaatttattgaactacacctaccctccgttgttggagaacgtacccatggtactccgagaatgcgcagaagatccggattcgatgagagtcatcgagcagttggatggagtcagattgatatggtcacttctaagaaacgattcgacaaaggtacaagccaatgctgcatggtcgttggtgccgtgcattcgcaacgctatcgattccggcgaaatggtgcggtgctttgtgggtggtttggaaatcatcgtcaacctgctgaaatcccccgatccccacgtgctggcctgcgtctgcgccgccatatccgaagtggccaaagatatcgagaacctggcggtgattacagattatggagtggtgccgatgttggccaacctagtagagaccgaagatgtggaattgaggcagcacctggcctcggctatcgcttattgttgcgcatggggttcaaactgtaagatgtttggtcgattaggagctattacgccgttggttcaatacatggccgataacaataccgaagtccatcgaacaacagctctagccctgttccatttgtccaagaaccccttcaattgcatcacgatgcacgagagcggagtggtgccattcttgctgaaggcggtgtcctcaactgactggaaactacaagaagcagccgctggatgtctggctaacatcaggaagctggcattagaggcggaaacggttcatttaatcaggaacaaatcagaaagtgaggaagaagacgac

SEQ ID NO: 209 - DNA, 1575 bp, Rhynchophorus ferrugineus
tggagagcgtcgctggtcgtgtgaaatcgaatttctgtctggtcgcggtgaaaatactattcctctttctagttgatcagacgcaaagtactacaacaaaatgtatagaaaaaggacgtttttacagaaaccccagtcccgcaccgacagtgtccgtttggtcagtagaggaatgttccagatattttctttgcctggacggggatgttttcgaatttaaatgttcatcaggcctggtatttgatgtggataagcaaatatgcagtgatagatcccaagttacaaactgtaacagagctacagaaactgtctcacaaaaacatccacaatctccatccgtaactcaaaggaaaactttttgcaccaacgaaacccacagaccttgcaatgataaagaaacgtgcatactacgggaatatttttgtgatggctcaaccgattgtcctgatggaagtgacgagttgcattgtgattcaacaaaagatatcccagcagctctaaaatgcgacccaacaagatgccaattaccaaaatgtttctgttctttgaatggaactagcatccccggaaatttaccattgtcagaggtacctcagatggtaatattgacgtttgaagatgccattaatgatgaaaatatagatatatatcacacactttttggtgggaaatacgtcaatccaaataactgtccgatagtagcaactttctttgtcagtcatcagtataacaactattactacactcaaaagttatggaaccaaggaaacgaaataggtgtacattcaattactcacaaaacaccagaagaatggtggtcaaacaatgctactctagaaaactggttcgatgaaatggttggccaagccaatatattaaacaagttttctagtgttaaattatccgaaattaaaggcatgcgggtaccctatttgaggatcggttggaacaggcaatttctaatgatgcgcgaatttggattccaatatgacagttcgatagttgcaccttattcctatattccactttggccttatacaatggattataaaatgtctcattattgtttcaggcagaactgccctactagatcatatccaggcatttgggaaatgatcatcaaccaactagaagcactagatattagttgcgccactttagactcttgtccatcggatttaagtggacaagaaatattccatacactcatgaggaatttcaaccgcttctacaatacaaacagagcaccattcggtattcatttacaagcttcttggtttgagaatagtgattacctggcagcatttgagacatttttgagccaaattttatccagacctgatgtttggtttgtgaccaactcgcaagccattgaatggattaagaatccaacacctttaaagaaactgttgaaatttcccccttggaaatgccacagaagtcttcgacctaaagagcttgtatgtgatgaaccaaatacttgttatctatccactgaacatttggacgagagcatcgaaatgcagacttgtacatcgtgtccaaaaaggtatccatggttaaggaacgaattcg

SEQ ID NO: 210 - DNA, 514 bp, Rhynchophorus ferrugineus
cgagaactgtttaatactaaatattttcacaagagagcttcctcggcaatcggacagtttaaaacctgttatggtgtggatccatggcggcggcttcctcactggcagtaacacaactaaaatctatggccccgaatttcttctgactgaagacgtagttctggtaacgattaattaccgtctagggattttaggataccttagactaaacaatccccagcttcatgtcagcgggaatatgggtttcaaggatcaagttgccgctctccgatgggtgaaaaacaatattatacagtttaatggagacccaaacaacgtaaccatcttcggcgagagtgctggaggagcgtccgtacactatcacatcctatctccactttccagtggtctgtttcataaagctatactgcaaagcggagttgctttaaatccttgggctgatgattcttatcacaacgctgtaactatcgcgaaatttagaaataaaaacatcgacactgaagcggaagctcta

SEQ ID NO: 211 - DNA, 558 bp, Rhynchophorus ferrugineus
gtgctaaagaaaatgttacttttgagtattctgtttctgactgcaggctcagccttggcttatgtcgaatatgacttagaccaagcagaggacctgtttgagcagttcatacttgaacataacagagtttataaagatattgaagagaaacaaatgagattcaacattttcaaagagaatttgctagaaatcaatcagcgtaataagcaacacggttacaacgttatgggtattaatcttttcgccgatatatcaaaagaagaattcagaaaaacacgccttggtttagttattgatggaaataaagcaccatgcacacttccacaagaaggtttcaatacacgcctatctcaagaaaatctaccagaaaactttgactggcgagacaaaggtgtagttacaagtataaaagaccaaggtcaatgccaaggatgttgggcattcagcattattggtaatttggagggccagtacgctatgaaacacggagttgataagcttacagatcgatctgaacagcagttgatcgactgttctaccaatgagtccggctgcggt

SEQ ID NO: 212 - DNA, 264 bp, Rhynchophorus ferrugineus
tactggtcgaaaaatccagtcctgcctgatcatccttacaaactgcttctagaaggaaaggttcaggatcttccttggttaatatctcatacgacagccgaaggattatatccagcattcgatttttattctaatgatcagcatcttattgatatcgacactaaatggaatgagataataccatttgtgctgcattataacgagagtgttgaaccaagactgaaagacgacgtatcaagacaaattagggaacactatctaggg

SEQ ID NO: 213 - DNA, 1527 bp, Rhynchophorus ferrugineus
gttctagggccaaaacccatcccgttgcttggcaatacttggcgattgctaccctttattggacaatacgatatatccgacgttgccaaattgtcacaattattctacaaggaatacggaaaaatcgtaaaactttccggtcttgttggaagacccgatctgttgtttatttatgatgcagatgaaatagaaaagatttatagaaatgaaggaccgactcctttcagaccttccatgccatgtttggtcaaatataaaagtgaagttagaagagatttttttggggaagaaggtggagtagttggagtgcatggggagccttggaagacatttagaaccaaagtacaaaaaccaatattacaattaaaaactgttaggaaatatgtcgaacctatcgaagctgttacgagcgatttcttagctaggatgatcgaaattagagatgagaatcaagaaatgccggcggattttgacaatgaaattcacaaatgggccttggaatgtataggcagagtatcgctggatgttagattaggttgtttagatccaaacttaaagcacgattccgaagctttaaaaattatcgaggccgccaaatacgcgttaaggaacatcgcaattttggagttgaggtttccgttttggagatatttcccgacaacattatggaccagatatgtcaagaacatggattattttgtcgaaatatgcatgagacatatcgatgaggcgatggatcgtttaaaacataaaactgtaaaagacgaaaaggatttatccttggtagagaggatactggcgagcgaacccgaccccaaaacggcttataaactggctttagatctaatcttagttggaatcgatacaatctcgatggcggtttgttccatattgtatcaattagcaatcagaccagaacaacaagaaaaaatgtatgcagaactcgtccggattttgccggacaaaaacgaaccgttgacagttgagaaacttaatcagctgacctttttaaaagcatttgtgaaagaagtcttcaggatgtactccacagtaataggaaatggaagaaccctccaagaagacacggtacttctaggataccacgtacccaaaggggttcaggtagtatttccgaccttggtaaccggcagcatgagcgagtacgtttcgaacccaactgaattccttccggagagatggatcaaacagggatccggccaggacaaaatccatccatttgcatcgttgccatatggatatggggcgcgtatgtgtcttggtagacgattcgctgatctcgaaatacaagtgctcttagctaaattgatcaggtcttacaaactggagttcctacacgacccactggaatacaaggtcactttcatgtacgccccagacggtgaacttaagtttaaagtaacagaaagaccctagaattcttcttcatacgagaggagactatttttactctgataattattttaaagtatacgtttttcacacgaaaaggtacttatgtaagatcgc

SEQ ID NO: 214 - DNA, 1114 bp, Rhynchophorus ferrugineus
agagaatggttgttattgacttgagtgtaaacttgcgaagtgataggtttagtcggcagtgttaaaaaaaaaataaaaaatgagtgtggcaaatgtatataagatttttgtaatatgtatgcacttatctgtgatgtgttgggcattgccaactcaaaagtgtaaggttgatgattcaatatgcatgaagacggctgctcagaatatggtgcagaccctcgctgccgggatgcctgagacggacatggaacccttggacgtgatgcgagtggactccatcaaggtggacttggctggactgaagttagtcatcaaggatgctgacgtgaaaggcctgaagaaggctactattgacaaaatcagcatcgacatggccaagaaggaattaactctgatgtatcatgctgatattatattgaaaggacaatacaaagcatcgggacgtctgctgattttgcccataagtggagatggagagactgtcatcaaactaaaaaatctgaatatagagatgaatatgccgtttgaaatagtcaaagatgcgaacggcaaggatgtgatcgaccttaagagctacaaatacaaatatgacgtgaaaaccaacgtgaatttccacatgacgaaccttttcaacgggaacaaagtcctaagtgatacgatgcattctttcatgaatgaaaactggaaggcgctttctgtcgagttcggtacccccatgctggaatcgccaaccgctaagatatttggtgtaatcaaaaagtaccttaaatcacaacccctagaggacattattacgtattgagcgataccaaaatttcttcgttaatatctatttttaagtatttatgggtagatttgttattttcagttttggattattattttgtcttatgtattaccttgtaataaaacttagatttatttattttggacacaccaaccactaacacgtttgagatacaatttaagtggtggtggacaaatggtagcgcccgcctgtggctgcaaaggtcccaggttcgaatcctgtccatcctcatgagtttgtatgccaatctaacttatgtatggtggttttcaattcattgacctataccgcttgcttccagtgaag

SEQ ID NO: 215 - DNA, 538 bp, Rhynchophorus ferrugineus
agaggagtttaaagttttactttcttcaattccggaagatcacttgatgtttccaaattcactcatgtctactcctcatgaggagttttcaaagaaaaatggccgcactaaaaacgtgaatcgcaatcgaaatggattgttagaaggaactgtttacaagggtgaacatcagtatgattatgaagattctcatacgtacattactgataagtctggtcagctttctgtttttaaaggcactgcggaggaagtctttaaggctcgttggaaaaatggtgacatcccaaagagcaaattttggtatgaccatttaacagcaatcaaagaccaagggcgatgcggttcctgctgggcattctctactgttgctacattggagtcatacacttcattgtattcaggccgtttaccgtcagcctcccctcaagccattttggattgtactgaaaatcccaacttgtgcggtggcatcggcggatgccaaggaggtattgaattagaggcttacgagagtgttattaaggcaggtggtgtccac

SEQ ID NO: 216 - DNA, 1347 bp, Rhynchophorus ferrugineus
ataatgttaataatagttttggtagcaggtgtgacaatcgggtttgtttcatatttaatatggttggagaattactggaaacgacgaggaattcacggaatcaagacggacttgctttttggtaatatcaagaaattaatagtcgggaaaaagcccttcccgtgttctgtcttggatagatacagaaccctaaaaggatttaagttgaaacatggaggtatattcacgtatactaaaccaacttacataccaatcgatccggtgatcataaaacacatcttacaagctgacgcgagacactttctcagtaggggcttgtatcacacgcctgcagacatcctcagtatgaatttgttaaatttggagggcgagagatggaaatgtcttcgagccaaattgtctcccacttttacctcgggtaaaataaagatcacgcatcaaattttgttggaaaaagccgagctgatggccgctgttgtcgggaaatccgttgatgacgatcaactttgtgatatcaaagatgtcctgtcacggtacactatcgatataattggtaactgcgcgtttggcatcgaaagtgattccttacaaaatgttgacgacatcttcataagatacgggaagaaaatctttgaaagaagtcgactgaaattggtgctacttcaagttctgccttggaacctcttggcctacctcggatacagatcggaaggacgtgatatcagccggttcttctccaatttcgtggcaaggatgatcgattacaggaagactaatgctatataccgaaaagactttcttcaactaatgctcgacacgaaaatcgatgaccacggtttaaccttagaagagatcacggctcaggcatatatattcttcactgccggttttgaaacgtcgtcgaatgccttacagtttgccttactggaactggcaggaaatccggaaatacaggacaaactgaggggtgaaatagaggaggttttgtcgaagtatcacggccagttagtgtatgaagctgttcaagagatggtgtatttggataaagttgtgaaagaaaccttgaggaaatatcccgcaacagccgctctacccagagtctgtaccaaagactacaaaattcctggaacgggcttgttgattgaagaaggagttcgcgttcaaatccccatttatggtatacacatggatccagagtactatccccaacccgagcagtttaatcccgaaaattttaacgaagaaaataaagcaaaacgattggattgtagtttcctgccctttggagaaggacctcgaatttgtataggtatgaaattcggcctgttgcaagtaaaaattggatta

SEQ ID NO: 217 - DNA, 341 bp, Rhynchophorus ferrugineus
ctgggtcttcctgacctcgtacaccgactaccacgcggactcggagcaggtcgcctggctcatcgaggacctcgagagcgtcgaccgctccgtcaccccgtgggtgatcgtcggcaaccacgctcccgtctacaacagctacaaggcccactaccaggaggccgagtgctaccgccagtcggtcgagcccatcctgtacgagtacaacgtcgacctcgtcttcgcgggccacgtccacgcctacgagcgctccttccccgtctacaactacaccctggaccccaccggcgccggtgcacatcaccgtcggcgatggtggcaacgtcgagaagctcgaggcc

SEQ ID NO: 218 - DNA, 346 bp, Rhynchophorus ferrugineus
aaatgggtcgcgatacctcattgtggggtgaagatgccatgcttttcaagcctgaacgctggattgatgagaatggccgtttgaagcgcaagtctcaattcgagtaccacgtcttcaacggtggtccccgtctgtgcttgggtatgaacttggctatctttgaagctaccttggtgattgccaccatggccaagagctttgatatctcgttcaccgacgattacttcaagaacaccaccatgacccacactctccccggtgaaaacacccctctctacaagttctctcttacccttcctatgaaggatcctttgactgttaaggtcaaggcttgtgtgtaaagtat

SEQ ID NO: 219 - DNA, 486 bp, Rhynchophorus ferrugineus
tagtgctatacaaattttgaattaaatagtatattggatacgtcatattaatatagggatttttcgaatatgttgtggcaaatatgtttgattttgatcgggatatacgcgatgtttcgttggagaaatagagaatttaataagattgcagaattacttccaaataaaatgaaacgggtgccgattttgggacatgctgtacatttcctgggaaattctaaagaacgtatgcaagtaatgaaggcaatggcagaaaatgcgatgaacaataaagaagggatgactagtgtatggctcggacataaattttttgttataattgcagatccggaaattgctgaagtggttttaaaaatgtgtttagaaaaagataacatgatgagatttacaagtgtgctaatcggtaatggcagcattttcgcaccagttaaaatttggcgtcctagacggaaaattttagctccaacctttggaacgaaaacccta

SEQ ID NO: 220 - DNA, 1503 bp, Rhynchophorus ferrugineus
gtataatcgagagaaaatgttgttttacgcggttgttgtattagttgccttcttgtggtttgctaggcgtcgacaaagttactggaaacgaagaaatctgtatcagatcgaaccgcaatttatattggggaatgccaggagagagctgatgggtaagcgctcgttgctggtaatgtttcgggacatttacgagcaggccagggctttaaaacagaagcatgtcgggatatacttcttcttggaacctgtttacgtaccgacggatccaaccatcgtcaaacacattatggtgaaggatttctcacacttcataggacacggtgggttcgctcatcctagtgaccgtctgtccatgcacctgtttagtatggagggtgaaccctggaaacttcttcgaacgaaactcactcccacgtttaccagcgttaagatgaagatgatgtttgagacgttgtcggctaagacggagggtctggagactttggtcgacaactacatcgttcgaggggaacccattgacgtcaaagacataacatcaagattcacgaccgatatcatcgccagctgtgcttttggtatcgagaatgatgccatgggcgaggataaaaatctcttccgccactacggacgaagagcagtcaaactcaataccttacgactattcctaacaaacactgtaccatcttcagtactgggacaactaggcttcaaaagtaacgaccatgacatcgaccaattcttctccaataccattatggataccataaaatatcgggaaaggttcaacgtattcagaaaggatttcatggacctgttacttcaaatgaaacgcggtgaagggaaatcaaataccgaacgtttgaccgaggatgaaattatcggacaatgttttatattcttcttggctggttttgagacatcgtcgaccaccatgacctttgctttattggagcttagtttacatgaggatattcaggacaggttgaggacggagattctggaggtccacgaacaacatgggggagtgctgacgtatgaggccctgatggagatgaagtacttagatatggtgataaatgaaacgttacgaaaatatccaccaatagcaagtatccctcgcgtttgtagcaagaattacaaagtaccgggaaccgacgtaaccatcgaaaaaggcactaaggttcaaatacccgtctggggcatacacatggacccggaatactacccgaatccggagatattcgatccagaaaatttcaataaggaaaacaaagccacaagaccggatatgaccttcttaccatttggagaggggcccagaatgtgtataggtcttcgttttggtatgatgcagacgaaaattggcctagtcagtttactgaaaaagttcaagttcaccgtaaatgacaagacccaagtaccaatccaaatcgagaaagtcagttttgtgttgtctgtggagggcgatgtctggctcaacgcttccagattatagattaacac

SEQ ID NO: 221 - DNA, 1548 bp, Rhynchophorus ferrugineus
aatccttacgatggaagcgttttagcctcctacgccgatctagttgtaattacgctaaactatagattaggaatattaggttttttaaatgctaacccagcaccacatctgaaggcccgtgtagctaactacggccttatggaccaaatagcggctttgcattggatccaacaaaacatcgccttgttcggcggcgacccaaacaatgtcacactggcaggacatggatccggagcggcttgtattaactttctaatgatttcgccgacggtaatgcccggattgtttcacagggccctgttgttgtctggttcggcgttgtcatcttgggcattggtggaagacccggttaactatgcagttaagctggctaaagaagttaactgtacgataccggaagacgttgggaaagatcacgaacaaatagtcgactgtcttcgggaaacacaacttcaacaattgttggaagctgatgtgacgccaccagcatatctaagtgcatttggacctagcgttgatggtgtggttattaaggctgactttgcaaaggagctggttacatatttcaagccgcaggaccttcaaagttttgtcggacccgtcaacgcgaatatgaaacgcagcgaagcgactttagttcctaagggcagcaacccttacgatctgttatttggcgttgtcaccagtgaggccctgtggcgtttctcgtccaacgatattcaagccgggttcgaaggagaacgtcgcgacaaaattattcggacttacgtacgcaatgcgtatacttatcacttgagcgagatatttttcacgatcgtcaacgaatatacggactgggaacggacagtgcaacatccaattaacacgagagatgcctgcgtggcagccttaagtgatgctcagttcgtggctccgttagtgcaaactggggatttactcagtgcgaaaccaccccagcccggtcaagaatcgacaaatccaaagacgttcttttatgtgtttgattatcaaacgaaggaaggcgattatccacagagaatgggtactgtacatggtgaagaattgccttatatgtttggtgctccgctagtggatggatttaatcatttcccaagaaattacactcgatcggaattggctttatctgaatcatttattatatttattgcaaacttcgctaggacaggaaatcccaatgaacatcacaagcaggagccggttttagcagcatcaagggaaaggaatcgatttcgatcaattgtttgggacgaatatgattcagtacatcaaaaatatttagaaataggaatgaaaccacgaatgaaaaatcatttccgcgcacaccagcttagtgtatggctacggctgataccagaactacaccgtgcaggtatggaggacgtcgtcgcccgacacaacctattcagaaatcacaacaacgccgacctctacgatggtgcagttcgtcccgaccctttatccagggttagttactacgacccgacaatggagctagtgaggcgacgcccgaacgcaacattaagcgct

SEQ ID NO: 222 - DNA, 391 bp, Rhynchophorus ferrugineus
agaatgatgccttgagcgacgatgaaaactatttccgaaaatacggcaggaaaatgtttagacccagcactttctacatgttgatcttcaataccgtcccatcgtggatcttaggaccaatcggtttcaaattcgctcctccggaactggacaaatttctcacagataccatgttggacacgattcagtatagaaataaaaacaacattcaccgtaaggatttcatgaatttactcttgcaactcaagagtggtgagaataacggcgatatctctcagaaagtgtcgagaaaattgactgaagacgaaattctggctcagtgttttgggttcttcatagccgggtacgagacgtcatcaaccacaatcacctttgctctgttagagttggc

SEQ ID NO: 223 - DNA, 1137 bp, Rhynchophorus ferrugineus
cacttctcaagcacaaaaaggaagttgtcactgaagacaatgctagttttgagtctattacttttaacctcaggcctggccctggcggtttatgaagaactggacataacccaagcagaagaactatttgagcagtttatgcaagactataatagagtttataatgatgatcaagaaaaacaaatgagattcaacattttcaaagaacatttgcttgaaattaatgagcaaaatcggcgtcatgggtacaatgttatgggtattaatgaattcgctgatatatcatcagaagaatttaagagaacacattttggtttagatcttgaactctcgggttcttgtaatccttataaaaaagtaaagtttgcagtaaaagcaccggaaagctttgattggcgagaaaaaggcatcgttacagaggtcaaaaaccaaggacaatgtggttcgtgttgggcattcagcactgttggaaatgtggagagtcaatatgcaaaagtacatggagctgataagctaataagtttatctgaacagcaattggttgactgcgataaatctaatacaggctgttttggaggaaatatgaaaagagctttattgaatttaattaaaactaatggactcatgtcggaggcagactatccttatacagaaagccagggtggttgccagtatgacgaaaacaaagcccaagtcaaggtcactgggtgcgaagacttctctggtactgatgaagtggaccttatagacattttggttaacaacggacctatcaccgtagctctggccggaactcctattcagctctataagggtggggtttataaaggttgtagctcctccgatgaaattaatcatggacttttattggttggatatggtacagatcctgatactcaagacccttactggatcatcaaaaactcttggggggcgagttttggcgagaatggctatatccgaatggtgagaggtaacccagattgcaaggttggaaacatcattacagtttcggctcaagtagcctaacataatgtcaaaaagcagtacgcaactctatattatcacagattttgaataaaaatccaatattttcatttgatttttcctaagtcttacccaaattattgttttctg

SEQ ID NO: 224 - DNA, 578 bp, Rhynchophorus ferrugineus
aataactgaatgctattataaatttacagtaaaatagtattgattccatacgttggagataataatttaactgtatcatttatagtttatgggtgatgaccagtttgtcagagctgtccatcaagctgccaaactaatgtcccaatacaccgacgtctacctatatcgtttttcatatcaaggagatgtttattcggatcgctccaatactgatgtatatcatgcagaagaattaaattatctctttgagattaccaataatcctcaactcacctcagaaaatgatctggctaaaagacatcagcttgtaaaaatgtggaccaattttgcaaagtactcgaatccaacccccaatgtagatcctgaactagactcaattatttgggaaaaaatgagctataaccaagataaatatctagatattggaaaagaactcaaaatgagctcagatttatcactgtacaacattgacttttgggaaactttgtacaaagtgtacggaaaatcgccattcgatacatattaaactgatgtctcaattttttatggatcttgaaaaaatctatttaattatgtac

SEQ ID NO: 225 - DNA, 1015 bp, Rhynchophorus ferrugineus
accattttcaacatgaaacgtttcgctttagcttgtttgttggtagttgctgccagtgcttctcttttgggggagcagggcgctcagtttcaagctttcaagctgaaacacggcaagacttacaaaaatcaagctgaggagaccaagcgtttcaccatcttcagagaaaacttggaaaaaattgccgcccacaatgcccgtcatgaacaaggacttgaaacctacactcttgctgccaaccaattcgccgatatgaccgccgaggaattctccgccatgctcggttaccaagctgccactaagccaaaattgaatatcaccaaaacctttgaaatgcccgaaggtgttcaagctccatcatctattgactggagagatcaaggacgcgttaccgctgttaaagaccaaggatcttgcggatcatgctgggctttctccatcactggatccactgaaggtgcttacgccctcaaaactggttcccttgtctccctctctgaacaacaattggtcgactgtgctaccgatatcaactacggttgcgacggtggatacttggaacaaaccttcccatacatcatcagcaaaggtctccagagcgaaagcagctacccatacaaaggtgttgatggatcctgcaaatactcatccagtagcgtagtcacccgcgtcagctcatacgtcaccatttacagcaacgaacaacaattgaaaaatgctgtcggtaccgtcggaccagtatctgttgccatcaacgccaactacctccaattctattccagcggtatcttccacaacgacaactgcagcccctactccttgaaccacggtgttttggttgttggatacagcagcagcgactactggatcgtcaagaactcctggggtggaagctggggcgaatccggctacttcagattcaagtacggagctaacgaatgcggtatcaccgaagataacgtatacccaatcatcaactaaatgttatcatttagttcctgtaaacattctgaaa

SEQ ID NO: 226 - DNA, 329 bp, Rhynchophorus ferrugineus
tgagaacatccggttacactggtattggctataaagatgaaaatgctttgaaagacgccgttgggtctgttggtccagtatcagtagctgtaaatgctgacccgttgcagagttatggcggtggagtcctaaatgtccaatgttccgattcaatcaaccatggtgttttagctgtaggatatggtcagcaagatggtcttaactattggctggtcaaaaattcttggggagatggttggggtgaatcaggatattacaaaatggcaattggaagtaatatgtgcggaatagctaatcaagcttgttatccaaacttgtaaacattgtgg

SEQ ID NO: 227 - DNA, 320 bp, Rhynchophorus ferrugineus
attgaggacatgacgtacgtgttgagagctaactctatagttggcaatgaaagcttgtacgttactcttgaaaatgaaggcttaatgaaggattggatgacaatgctgttcacgaattttgtacaaagcgggaaccccaataccaacgacgacggcttcgtcggctactggcagccggtcaacaagcacgaggtctcctaccaggacatcagcaagcccggcgagagctacagcacaggactcactgacaattttgtcgacatgaagacatttttcgacagcatcttcgacaaggtcacagggtaaactatactccaaat

SEQ ID NO: 228 - DNA, 1195 bp, Rhynchophorus ferrugineus
tctgttattgatgctttaaatcagcattctgttgaaaaatctgttttagaatacgtcaatgcttggcgtgaagccagtcctatttctgaggatatagtgacttctcgtttagatgtcattcgccgcaatttggagtacatctataagcacaattcaagtgttgacaaagctcttcaactcgcagctgccactcgcggtatttacgctgaaacaaaatcagtcttaagattagctcctaaccatttgcttcatttaactgacaatgagtacagagaaatgttgggcttcaacgcgaaagaggccgaaaagtatttgaacacaattggcgctttgcatcagaactcattgcctgaaactacagatgaggccttacccaacgcttatgataatcgtgagacttcctgtgttactgctgttaaggatcaaggtcaatgtggttcttgttgggcgttctcaacgatggagacgttggaaagtgtttattgtcgtcacagtgctgaagacaaaattttacctattctttcggagcaagaattagtagattgcagcagttcgtatggtaacagcggttgtatgggtggcttgatggatttggcaggtcagtacttgataaaaaatggagttttattagagaaagactatccgtacaaagctcggactggcgcctgtcaagctgatgtttctatttctatggctgaccgaaagattgtcaaggggtacaaaaaattgtttaatgcagaacaaatgaaaaaaagtttagtggaaaatggccctctttcaattgccattgacgctggttgttctgagtttcgtttctactcttcgggtgttattcctaacacagcttgtacttctgcattgaatcatgctattgttttgtctggatatgacaacgatcaaaatgcttggattgttcgtaactcatggggtacaacctggggtgatgaaggttatgccaagctggaattggaaggaaacacagcgggtattaaatctttcgttgttgaatttcaaactcaacgtaactccaacttcgatgctcgtgtcttgaagtctcaagatgaagatcatattgcacaaaatggccaggagcaacagcagcaagagtcgattcgcatctaaaaatgacgagttctgtgaatttttttcattaaataaatggcatttttttttaatggcatttttatgaatttcg

SEQ ID NO: 229 - DNA, 491 bp, Rhynchophorus ferrugineus
actctggtcaccctcaggtggtttttattatacatagcaaggaatgcaaaaatacaatctcagttaagagatgacttaaagactattttaaacgaccgtgatccatcgcttaatgacatggaatcccttccatttgtggaagcctgtctatcggaaactcaaagaattcgatcagttgttccaattggtattccacatggcgctttggatgatattaagctaaatggttacgttataccaaagggtgccatgattgttcctctacagtgggccgtacacatgaacgaaaaagtatatcctgagcctgaaaattttaatccaagtcgttttatcaatgaagaaggacgatatttcaaaccagaatattttattccatttcagaatggaaaaagaatgtgcattggcgacgagttagccagaatgatgatgtttttggtatctactactattctgaagacgtttcatttagatcttgaagatcacaagacgtg

SEQ ID NO: 230 - DNA, 576 bp, Rhynchophorus ferrugineus
gggaaaagccgttagatactttattatccacaccggtcgttgcacctgaattttcttttgccttcggcccaagtgtagatggagtggttatcgatacaggagaacccccaggtggcgaaaatgcccactacactgactatgatagtccaggaagcaacagcaaacaaagcaaaacggaagtacagaacgccatcaacattttgaacagcgtccttctgcgaaaatcggttatatcgaagctaagtcgctacgacttactattgggggtcgtcaaggcggaagcctatttcgcctttaacggggaagacgtacaatacggcatcgaggcggatcgacgaacgaaaattctgcgaaccttcgtgaaaaacacgtacagctaccacctcagcgaaatcctggcgacaattgttaacgaatacactgattgggaaaggcccgtccagcatccaatcaatataagggacgaaacattagaagcgctctcggacgcacagttcgtggcgccggtcgtccatacagccgatttacattcagctgagcaccggaactcttatttgtacgtttttgattatcaga

SEQ ID NO: 231 - DNA, 233 bp, Rhynchophorus ferrugineus
ataaaattcctggaacgggcttgttgattgaagaaggaattcgcgttcaaatccccatttatggaatacacatggatccagagtactatcccctacccgagcagtttaatcccgaaaatttcaacgaagaaaataaagcaaaacgattggattgtagtttcctgccctttggagaaggacctcgaatttgtataggtatgaaattcggtctgttgcaagtaaaaattggatta

SEQ ID NO: 232 - DNA, 230 bp, Rhynchophorus ferrugineus
gtggctttatttggatgcattacaatatattaacaacacacacaaagatttggacttagtttattttactggtgatataattgatcactccatttggaaagattcgcatcaagacaattccaaagatataagatttgtatttgaccacctagcccaatcatttccaaatatacctatcttgccaactttgggtaatcatgaatcaataccattaaatatgttccctcctc

SEQ ID NO: 233 - DNA, 515 bp, Rhynchophorus ferrugineus
catttcgataaagaaagtaaagcactaacgtttaccatgttaatacctagattgatacaaaattctgattataacataagtggacaagtgcttagcttgccactcagtggcattggaacgtctacatttgaattatatgatatggccttaaaattttacttaatacttgacgaatacactcgcgatgcaaaacggtactataaaattaaatctattcaagcagatatgcccatatcaggattcaaagcgcattatgacaatctcttcgatggaaataaggtgttaggtgacagtgtaaatgaaatgtttaataaagaatggaaagttatatatgacatcgtccaacatcccgttgaaaaagcatatggaaaggatttcgaaatttatattcaaacgtttttggatcatgtaccagctaaagatcttttctgatagtacaaagctaacagaagtttgtaataaacttaaataaagtttcagagaaaaatatgaaaacatcctataataaaacttgc

SEQ ID NO: 234 - DNA, 288 bp, Rhynchophorus ferrugineus
aaccgatctggaactgtccggatacaacgtcaacgcaggcagtgtcgtcctctgccagacatctctggcatgcttgaacgacgcttatttcaaacaagccaaaaaattccgtccagaaaggtggctgaacgaagagaaatacgagactgccgccaacgcggcctacctggtcacacctttcggatacggcagaagaatatgtccgggaaaacgatacatcgaacaagtactgccgataatactcgataaaacggtagagaagttcaaaatccgagcggataaagtcat

SEQ ID NO: 235 - DNA, 1147 bp, Rhynchophorus ferrugineus
tatcttacgatatattcgaaagataagttttgggtataaattacagaaattgtagttattattataattgtctggcaaatcaagaacatgagggtgctggttctagcagttttagttttttctatttctgtgtacgcagaattgcaaaatgacatattatggaaaaattacaagatcaaacatggaaaaacctacaaaaaccaggttgaagaaattaaacgctatgcaatttatcaagaacatatccgcagtatagaggaacataacgctcgtttcgaaaaaggattaactagttataaaaaaggagtcaaccagtttaccgatatgactagagatgaatatcttgctatacttacgctacaacttaatggcaaacctactaaaactggaaaccggaccatttttaaaagctccactgatgatgttccagactcaattgattggagagatagtggcatagttactgctataaaagatcaaggcacctgtggtgcatgttgggccttttctgctactggagctttggaagctgcatatgcccaaaaaaccgggaatctagtgtctttttctgaacagcaaattgttgattgtagcaaggtagagccttatggaatggcaggttgtaatggaggttttatggaagctgcttttgattatgttacggattatggcattcaaactgaaacatcttatccatatgaaggtgtcgatggcagctgccgtttttctggtgaatatgtcacgaaagctaatggttatattgatttgccagaatttgaagaagatgcattggtagaagctgttggtaccataggccctatatctgttgcaatagacgctaataatttagcagaatatgctagtggaatatatgatgaaccttgttcctcatttgtgttaaatcatggcgttttagctgtgggttatggtattgaaaatggacaaccttattggttgattaaaaactcatggggtgttagttggggtgaagaaggatacttcaaattgaaacgaggtgaaaatcaatgtggtgtggctgtagaaccatcctatccacttctttaacaatattttgtcaatcacaaccaatatgttaaacaagcagtagaaagtcatgattgtacataaagtcaatgaaataataaac

SEQ ID NO: 236 - DNA, 947 bp, Rhynchophorus ferrugineus
attttataaacttccctaatcacggattgtatattgacgaatccgtcgaccctctatcggtacatcttttcaatatggagggttacaggtggaagaatgtaagggcaaagttacctttggcattcacggcagctaaaatgagacggaacgttatcataatgaatgagacctgcaaagagtttttgaaaattatagataaatacgaatctgaaaacaaatcaatcaatattaaggatgtgctcactcggtcagtgcgtgtatattgggtatggaatccaatacgctaaagaatcaaaaccccgagttacttcgagaaagtagagcattctttgacaatcagtggagcagagtaagcaatactctggttattcttatacctcgacctgttttatccaagctgaacttcaaattattcacgaaaagtgccaccaaatacttcttaaacatgtttaaaatgattaaagaacatagacaaactgaaactaccaaacgaaatgatttaactgatttactgctggacttggccgataagaacaagtcacatcccgattttaatggggttggtacaatggaaccattaaactttaacgaatttgcggcacaattgtatattttctttcaagctgggttcgaaacttcctcgagtacgcaagcctttgccctatacgaactagcatcaaatcaaacaattcaagataaactaaggctcgaaattaatgaggttttaaagaaacacaatggacagttcacatacgattcagttaacgatatggattacttgggaagggttatagatgaaactttaagaaaatatccgatctttcccgtattaccacgtgctgctactgctgactatcaagtgccaggaaccgatgtaataatagagaaaaattcgttcgtactagttactaatttgggcgtccactatgatccagaatactatccag

SEQ ID NO: 237 - DNA, 411 bp, Rhynchophorus ferrugineus
cgtacaaggaatggttatacgaccaggaaatgaattgccattggttgaagtttatcgaggtataccatatgccgcgccccctgttggacacttaagatttatgccacctagtagtacattatatacgtggccagatgtcaagcaggcttccgtctttggacctgtttgcccacaaaagtttccaaacgagtctactatgacggaagaacgaaaagcatatttttccgatttaaaaacatttttaactaacgagagtgaagactgtctatacttgaacatttatgccccatatcaagaatctagtacacattcccgaacctatcctgtcatcgtttttatacatggggaatcatttgaatggaactcaggaaatccatatgacggaagtgtattagcaggtttcggaacaag

SEQ ID NO: 238 - DNA, 702 bp, Rhynchophorus ferrugineus
gattgcccaaattttcaccaacaacaacttctccggtgtgatttccgatgcgattgaatctgacattgctcaagttcaaaagatcttgacccaccacgctaaaactggagaaacccttgacttgtgccgcttgttctttgcttatacattgtcttccttcatgaagatgtcgttcggtttcgaccctggatgccttttggacgatcgttgtgttgctgtccccttcgctgttgcttttgatttcgctcaagaacatgttatccgtcgtgtcatcaccccctggtggagattgaccgaaccattcacaaaggatggtcgtcgcatgaaggaatccttgaagacaatggacacttttgtatatggaattattgacaagcgccaagaggaacgtcgtttggccgcatccggtaaggaagttgttaaggatgagactgtccgccgcaatcttttggatatgttcttggacattaaggatgccaacggtaagcctttggaccgcaagtaccttcgtgacgccgtgttgaatttgattattgctggtcgtgacaccactgctcaagcattgtcatggacctggttccgtttgatccacgaccgtcccgattatttgcaaaagatccgcgaagaagttgactctttcgatgatattcgtttcgataaccaccgtgaactcgtttacactttggctgctttccacgaagg

SEQ ID NO: 239 - DNA, 369 bp, Rhynchophorus ferrugineus
cctcgatgaccaatgagcaagcctttgccgagttgtactactctcaaaaggctatcaaggaagtcttgggcatcactgtacaatgctggcgccctccttatggtgacgttgatgaccgtattcgtgctatagctgcgtctttgggtatgagaactattgtttgggaacaagacacctttgattacgactggagcaccctcggcatcaactatgttttgcaaagatacacagacatcttggatatgggcaagaatggtacatataaaacgcacggtcctattgtgctctcgcacgaactcgataacatgaccatgcaagagtctcaaaatcaccttcccgagatgcaaaaggttttcaacgttgtccctg

SEQ ID NO: 240 - DNA, 476 bp, Rhynchophorus ferrugineus
tttgaatattgtgggccattcaatcaaggaattttattctcctaattccgattttgataatttgtccggtgtacaataccattctaatcaggattttgataaatccattataaaacaaggagaactccaagcaccatacacgcccgtatacttttatgaatttacttacagtggtaaaatgggcaacaacataaatcatctagaaggatctggtaaagtcactcacggtgaagagcaaaattacatattcagtagatggtacagtaacgaagtacctgataacactgatttaagtaatttcccccagaccgatataaacgttcattctagatttatgacactcttcaccaatttcgcgaaacatttaaatccaacgccaaaagaagatccgatactggaaaatgtgatttggccaactgttcggtcagataacttcgtttatttagatatcggagaaaatttagttgtaaaaaatg

SEQ ID NO: 241 - DNA, 399 bp, Rhynchophorus ferrugineus
gctcactgagctatgatacacctgaatgcacaaaagtgtgctccgatccttctttggattacaaagaatctcttacctatggcgaaagaccctcttacttcgaggacgaacaacaaattcaattggaaatcttgaaaaatggacccgtcgaaactagcttcagcgttatggatgattttcccaattacaaatcaggcgtttacgaagctactagcgataactgggttggtcgtcattctatgaagatccttggttggggagttgaagatggtactccatactggctcattgcaaactcctggaataccgactggggtctagatggatacgttaaattcttacgtggagaaaaccatcttaaaattgagtccaattgcgtggctgctttaccaattttgt

SEQ ID NO: 242 - DNA, 270 bp, Rhynchophorus ferrugineus
gaaaaacttttccagcgagtaattttaatgtcgggaaccgctctagcagattgggctctcgttagtaagcctcttgatatttcaattcaagttgcacaatccttgaattgccaactgcgtgataacttctcagactgtttacgacgaaaaaggttagaccaactcatgtccgccgttgctgttaccgatccctataaaacaacctttggtcctgtcgttgatgatagatttgtgcccaatgatcctaaaaagtcaatgacgcagtacacc

SEQ ID NO: 243 - DNA, 348 bp, Rhynchophorus ferrugineus
agctccgaaagatctatcgtcctcaaccaactggtgggcaaggagggtttgctggcgaacatatccaggaacatcgagaggaacgtggacctgggactgggtgtgttgggcggcgtcataccggcccatttcgagaactatttcagagtcaagggggactccatcgaggataagctcgacaaggtggcggaggccacagcggacgccctcttcaacgtccccgccttcctcaccgcccaactgtggagtggttcgaacgccttcctctataacttcgaacacgcgggaaagctgcacaaggggtccagctttttgaagggattgccactgatcggtaatcgtactaat

SEQ ID NO: 244 - DNA, 591 bp, Rhynchophorus ferrugineus
tttttatctactggagataatgtaatacccggaaatcttggaatgaaggaccaaatattcgcattaaaatgggtacaagagaatattgaatattttggtggggacccgacaaaagtaaccatttttggccaaagcgctgggagcgcatccgtatcttatcttttattaagtcccttagcaacaggtttatttcgagctgccattctggaaagcggctctgctttaagtccttggggttaccaaagaaaccatgttgagatagcatataaaaccgctgctattttaaatgaagcattcaatgaaactaatacaaatagtacggaattactatcatttttaaaaacagttccagcacgagatcttgatgctgcatcatttcaaatcacccaacgactggagtacccggggaatatgcagatatcaaaaggatgcttctacacaccatcaattgaaccagtccatgatgacgctttcttaacatcctatcagtatgaaagttttgagcaaggcttattcaataaagtaccggttttaataggtttaaacgcggaagaaagcatgttcatgttatcagataccttcccaactacg

SEQ ID NO: 245 - DNA, 499 bp, Rhynchophorus ferrugineus
cgaaaacgccgaaatgtttgaggacttgcgaatctaattacaacgttgcgtacaagaaagacaaacggtacggtaaacatgttttctcagtaagaggaggtgacgattatattagagctgaattatttacgaatggtccagttgaaggtgcttttaccgtttattctgacttgctgttgtacaagagcggtgtttacaagcatgtccagggagacgctcttggaggacacgccatcaagattctgggttggggcgtggagaacggagtcaagtattggctgatcgctaactcctggaactctgactggggcgataacggtttcttcaagatcctccgaggtgaagaccactgtggcattgaaagttctatagtagctggagagcccttgctcaattaataacaaatgtgtttgaatacctaacaactattgttatctgtatgtttaatttatgttactgatataagtaccaaacaagctatcattgaattgctcatgag

SEQ ID NO: 246 - DNA, 625 bp, Rhynchophorus ferrugineus
gttttgcttcacgcacacgaacgaattcttattatgtcttctgaattatttgttgatggtgcaaaccctggaagttcggatgatgctatccgtaccagccgcatcttgaaatactccgcgattgccgcgggtgccactggtttactcggtgctggtgcttgggctggacacgctgctgtcaaagaaactaccaagggttttcccactatgactgactacctcagtgcgcatgctactcgcttgacttctaagcactggtctgctttcgatgagtttaaggcgacgcacggaaaaaagtatcacaactttgccgatgaattcaagcactttgaaaattttcaaaaagcgtacatctacattgagacgaaaaacactgatggtcctcgcaagtcaaagttagctatcaacaagtacagtgacctttcccgtgaagagatggtacaggcgaatcgtttaggtttaaagattgatcctcaaaatcgtcccttcggttctgctcctttccttggtcgtttgaatgctaacgacatcttatttgatgatgccattcctgaagccgttgatcaccgtgaaggaggttgtgtctctgcgatccgtgaccaaggtcagtgcggttcatgccggt

SEQ ID NO: 247 - DNA, 246 bp, Rhynchophorus ferrugineus
attgtctttgttgagggtaatcaatggaaaaatcaacgaaagttttctctacatagtctcaggcaattcggtttgggacgtaaaatcatggaggaacaaattcgagaggaatgcatgttattgatcgagaatttcagcagtcaatgtaagaaaccgatattgatggatgacgcctttggaattcccattttgaatgttttgtggataatgattgcagggaaacgctttgatactgatgataaaacg

SEQ ID NO: 248 - DNA, 469 bp, Rhynchophorus ferrugineus
atgtactccggctaagaaattacaaaccatcgggaagaaacgacttcattgacctgatgttggaatgtaaacagaaagggactatcgtcggggaatctatcgagaagcgaaagaaggatggaactccagaaatcgcgtcccttgagctggacgacacgctgattgcggcacaagtgttcatctttttcgtggccggatttgagacctcctcgtctgctaccagctacacgttacacgagctagctttccatcctgaagtccaagtgaaggtacaggaagaaattgacacagttttggccaagcatgataacaaattatcttatgattcagtcaatgagatgacttatttgcaatggacgctcaaagaagctatgcggatgctgccttcgctcgggtacataagcagacaaagtgcgaggccgtatacgtttccggagctagatctgtccatagatgcagaagtggcggt

SEQ ID NO: 249 - DNA, 445 bp, Rhynchophorus ferrugineus
ttccaagtggatttaaaataataaacacactccgctttatgggcaaccgtagtgcgtattttcaataatatattctatagtataaaaagtgatattaatacaatcgaaacgaactaactatcacaacgattactaaacgaaactgtatttacgcgagtgaattacctatatactccaaaattagttgcatatatgaattattcgacaatgtgttacataacgaaatcaatgaccatcattataacactatattcggtgtcgatgggagatccaaacattcaatttccccggaacattcaaaattataatgattttcggatgccaatgcgagaaataattctgaaaaaacaaggtcgcgtacaaggaatggttatacgaccaggaaatgaattgccattggtggaagtttatcgaggtataccatatgccgcgccccctgttggac

SEQ ID NO: 250 - DNA, 365 bp, Rhynchophorus ferrugineus
ggattatatccagccagcgcgatgtataaaaaagaaatatatttagaaaccatcgataagagatggaatgagctaatcccccatatactcatgtacaatttcacagtcgatcctaaattaatggacacagtatcagccagtattcgcaagaaatatatgaagaatcaaccagtagaacgatcaacgttcgagaatctcgtagaagcatgtggtgacagaaacttcttaagcgatatggataaagctataaaactgcacagcgcaggaattgattcgccaatgtggttgtttctgttatcttatcgaggcgacgcagactgggtcaaagtagataaatttcaacatactcgaatagataacaaggc

SEQ ID NO: 251 - DNA, 293 bp, Rhynchophorus ferrugineus
gccatgttgttaataaccatttttgcagtatttaattttcttaacttaatttctggaattacattcaaatattgcaagggatcggaatctaacacagatgcttgcttagttgatgctattagtgacgctttacaaaaattaagaacaggttgtgaagaattcggtctaaaaaatttggatgtatatatagtgggacctatttccgtagaagctggaaacggagcaattcacataatacaaaataattggaatattgagctaagaggcatagccgatgctatagtaaaggaggc

SEQ ID NO: 252 - DNA, 376 bp, Rhynchophorus ferrugineus
tcgttgttggtggctttgccgatggtatcgctcacttgagctacatcgatttgtatggtaccacctacgaagatgattttattgccactggtaacatgggtatgtacatcgctaagcccatcttaaacgataactggaaacccgacttgtcttatgaagaagcccgtgcttttcttgaacaagctttacgtgttcttttctatcgtgactgtactgccactcacaaaattgaaattatgaaaatcgacgctacgggagtgcacattgaatcaggtatcgaacttgaccacaaatgggaccataacgcttttgtccgcaaaaatgtatctacttctattggtgtctcctggtgatcacatacatcatttgaaacacc

SEQ ID NO: 253 - DNA, 595 bp, Rhynchophorus ferrugineus
tagctatgaaacttcaaatcgttttagccgtcgttttagcggtagcatcagctactccagaacttggctctagtcagcgctggttggcgttcaagagtaaacatgttaaaaagtactctgacaaagtagaagaggtcaagcgttttgccattttccaagacaatttgaagaagatcgcggtacataatgcccgttatgagaaaggagaagagacttacaaaatgggaatcaccaaatttgctgacatgactgccgatgagtttggagcaatgttgagacaatcctacaaacaaagagcgaaagtcaatgctacaagacttttatacaaagctccagttgattccgtttctccatcgagctatgattggagatctcaaaacgtcgtgaatcctgttaaagaccaaggacagtgtggttcatgttgggcattctctagtgttgctgttgttgaaagtgcttatgctatcaaaactggtaaattggtgtctctgtctgaacaacaactagtggattgtgctcgtggaggatcatatataagcgaaggatgtgatggaggactctacgaggacggtttaggatatgtggtggagaatgg

SEQ ID NO: 254 - DNA, 315 bp, Rhynchophorus ferrugineus
ggaaaataagcacatgatcgcgaaacacaaccagaaggcgatgcagggccacaagtcgtacaccctcgagatcaatcactacggcgatctgctgcaccacgagtttgtgcgcattatgaacggctaccagcaccacttgaaggcagcttcggaaaatggcagtctgtacatgacccccgctaacgtcaacttgcccgaccaagtcgattggcgcgaacataacatggtcaccccagtcaaggatcaaggacagtgtggctcgtgctggtctttcagtgcgactggcgcccttgaaggtcaacactcgcgcaaggc

SEQ ID NO: 255 - DNA, 435 bp, Rhynchophorus ferrugineus
gatctccgctaatatatgaaacatacttcagtaaatgattgttttatatttagcaacgcaaatgccactacgataaaaacttggcgattgctaacattacctcgtgggccgttttaccagcacgtgatgaaaaggcgttagaagctgctgttgctaaaatgggaccgattgctatatctatcaatgcggccccgcatacctttcaattttaccacagaggaatttacgacgatccaacatgtacttcgtttactgttaatcatgccatgttactcgttggttatacaagagatgcttggatactgaaaaactggtggggcaaacattggggtgaacagggatatatgagacttcgacgacatcataacagatgtggagtagcaaattatgctgcttatgcattagtttaaccataacacatatcattaataaaat

SEQ ID NO: 256 - DNA, 1014 bp, Rhynchophorus ferrugineus
gatggatggaactccgttactcgatcacttcccgtaaatagaaaaggacggatgctggctccagtctcttttacaatcaccgaaagtgagtgccagtgtccgttctaacaacattactggaaattattgtgggggcgtctcgatatcagatgtacaggatcgttcattacaaggcaacagttccatttcctcgacatggataacacggattttcttcattaagcggtacaaaatttaacagttaccagacttggcaaggtgaaatgttctgtatgaaatgtgtggtgcgttgtgttagggcggatatattacccagaggtggtgctttatcgagaatagctagacaatcaagtacaacggtaacgaagactattgatgatgttccaggtcctaaagggttgcctcttatcggtactacactatccctgttgatggcaggttccacaccgaaacttcatcattatatagataaaagacataaagaatacgggtctatttttaaggaaagtatcggaccagtgccatgtatatttattagtgatgccaaaaccatcagagatgtgttcgcccacgaaggaaagtaccctatccatgtactaccagaagcttggactacctataacactttacataatgtatcaagaggaatattcttcatggacggcgaggaatggtggcattttcgtcgaatattgaacgcagctctgatgaagggcgaccaagaatggcttgaagatagctgcgtacctgccgttgaaaatattatgcgaagaattcgaacggtttctagttgtacatcatcatatcctgatatggagcagatattgtattcctggtcattagaggtaataatatcggtgctagtcggaccacagaattatctgttagcgaaagatcaaattgccgatagggtagacgagttggcgtcaacgttacgtcttatttttgagactagttctaagctaatgttgatttcaagtaaattcgctgcaaaattcggcattccaagacggc

SEQ ID NO: 257 - DNA, 513 bp, Rhynchophorus ferrugineus
gtcatggctctgcggggatacttttgtgtagtgtatttgtttttatttttggattattatcagtgtgatccagtgccggaagctcagagaacaccgttaacctctcgtacggtcaaaacaaaatacggtgacgtcagtggggtaatagttactcccgaatccaaacatttggaaccggtggaagtgtttcgtggtataccgtacgccagtccgccgttgggctcgctgagatttatgcctcctgtaacaggggctctttggcaaggggttaagatagcagatacatttagtccggtgtgtccgcagagacttccggatatttcgaacgagactgcggctttacggaagatgccgagaggccgactggaatatttaaaacgtctcttaccgtacctgaagaatcagagcgaggattgtctttacctcaacatatatgctccagcacaagcaggtaccagggagggcagcagccaagccaagtatccggtgattgtatttattcacggcgaaagc

SEQ ID NO: 258 - DNA, 320 bp, Rhynchophorus ferrugineus
cggactcaacgccgtgcgcgccaggaacacgtcgtcgatcttctcgcacgcgtccgtccaggaggtgccttcgagcgtcgactgggtcaagcgcggcgccgtcacgcccgtgaagaaccagggcacctgtggttcctgctgggcgttcagcaccaccggagctatcgaggggatcaactttgtgaagacgggcgagctggtctcgctctctgagcaacagctggtggactgcgcgaccgagaagaacaacggctgcggcggcggcctcatggactgggcgttcgagtacgtcacaaagaacggcggcatcgacaccgagg

SEQ ID NO: 259 - DNA, 275 bp, Rhynchophorus ferrugineus
atttacggtccgatatttcgaggcaccattggtcctacgcatatagtttacttatccaaggctgaacatttaaaggtaatattgcggagttacaccaacattaagaagggaagatcatacaacgctcttaaaccttggttaggagatggattgatatctggcggcggtgaacactggaaatttcatagaaaagtgatcaggccggcattctatgtcacagtcttggataaatacatggacgtattttccaataactccagtgaactgttggatat

SEQ ID NO: 260 - DNA, 1131 bp, Rhynchophorus ferrugineus
cagtacaccagtatatttaaaaggtttgacttgatgtacggtgtgacagaaatggaaagcatccatttacctctaggaggagacacgggcctaaaagacggaatatatgaggaacaaaaagatgaggagttaagaaaatatatgcgtacaaggtgtgaggttaagcctaatgtatgtttcgaggaaactagggccaagtataattataacaagctaagtttccagcgggaccagggaagatacaggcattacatgggccacgaaccagacagagccactctagccagagacgaattgcttgacatattgtctgacgctaggacagttgcgcctgtggtccagactggattataccattccgctcttaatctacagtcatatttctacgttttcactcacaaaactcgatcgaaacgctatatcagaaacaaaacctacaacggggaagagctaccatatgtgttcggtattccgattcgccgtactgagatcgatgactttactgacgaagagaaaaagttgtccaagaaaattatgaaatttttctgcaattttgcttatacaggaaatccgaatgtaccgagaactaactacccaataggggactttaaaagctggcatccgtttcataaagaatggcatgcgtttgatgaagagcaacaacattacctacagctcggtattccaattgagaataaacagttttatcgtaaggaacaaatggactattggattaatgagtttcctaatatcactaaacttacatcaaagaagaatccacttccttggattaatcatatggatccctacgaaaatttcaacaaaacttcagattccaaagaagataaggactattacagaaagacgccatatctttttggaccatcaaatcgagaagattacagtaaaggtatttttggcagacttttgacagctccaccgccatcgcccgaggaagtgaagcaggacgttccagcactgggtatttttgttacagttggagcgttatttcttctggcaaatatagtcatattcgtctttttatactataaatgtctaagaaagaggaaaaacgaaaacatgtcttcaccagaaaataacacaccggacgaccaagacgaaaaaaatgaa

SEQ ID NO: 261 - DNA, 305 bp, Rhynchophorus ferrugineus
gccagttttagtacgcagagtctgtccgacaaaatgtccatttattataaatttatttggtgttctgtgtttctgcaaacagttctttccgatttgcagttgcctgaaccttgcttagcgacagatatcgattgtctcactaaagtaactcaggtgtttttggataacactagtggtggaataccaaaatatgacataagacctttggaccctataaccatcccatctttagacgtcacgcccgagggagttggtgttacgtttcatttcaaaaatattgtcgtcaatggctttaagaaccagaa

SEQ ID NO: 262 - DNA, 606 bp, Rhynchophorus ferrugineus
ccacaatctcgttctgtttattggaactgacacagcatccggatatacagcagaaaatgagagaagaggccagagcattatggaagaaacatggtggtaaattcacttatgaagctgtacaagagatgacgtacattgaaagtgtagtgaaagaaacactgaggatgtatccaccacttgcaatcctacctagagtttgcacgaagaattacaaagtacccaacacggaggtgatagttgaaaaaggcactacattgaaaatatctgtctggggtctacatttggatcctgaatatttccctgatccgtataaattcgatccggacagatttagtgctgagaataaacacaaaatcaaccctcacgcatacataccattcggtgatgggcctagacagtgtttaggattgaggttcgctctgttagagtctaaacttggactggccatgctattgaaagactttaatttcactttgcacgagaccacgccttatccacccaaatacgtggtgaataatttcattccaactgtggaaggaggggtactactcaaaataactaaagcagattaatacagttaagttccttatattacaattcaagaat

SEQ ID NO: 263 - DNA, 528 bp, Rhynchophorus ferrugineus
agggattgccactgatcggtaatcgtactaatgacaatgacggcggcatcgtcggccacggcgacgagctagcgtacatcttcgacgcgcaagatatcgagggcaatcccctacccacccggcaacccaccgacgaagaccttaaggtacgcaacgtattcctgcggatgttgggcgacttcgcccgtaagggcgagataacggtgaacggcgaaatggcgcgcgccttcagcggtaacgagaacaactacatccgcgtcgcagccaagcccgcactggccgacaagttccgcttctgtcaaatggccctctggaccaacatcggggaacgcctgaagacctcgtcctgccagttcctgaacgccttgggcgtgaccggcgacctgctcgacagcaacgccctcgctaaggtgaagaaccccatggatatcttctcggtgttcaggggttgaggctgattacactaattaccacgggattggcttaagattacttttatttactctgttacaaaatagaaagtctgct

SEQ ID NO: 264 - DNA, 914 bp, Rhynchophorus ferrugineus
aaattcggcattccaaggtcagtataagatggcaacgattcgaagcagcagtttcaacagcattacataatgtggcgaacttagtcgaactattactaaacaattatgtaagagaaaacgaaggactgttggggaaattaagaggaaaaatgacaacaaacgaattatctcgtatcgtaacggatcttatattggctgccggcgacacaacggcgtattcaatggaatggactttatatctgattggaaaaaacctagacgtccaaaagaaactccgagaacaaattgcagaggatgaaaagaagagtcagtgctggacctctaacctgtatttaaaaaacactattaaggaatctctgcgattatacccagtagctccatttttaactcgaattctaccgaaacctgcaacgatccaaggatattatatgccggcaggttccgttctgataatgtcgattttctcgacaggccgagatgccatcaattttccgaatccactaaaatttgaccccgacagatggatgagagacgataacaatggcgtcgctgcccgatctgcatctataccgtttgcaataggttctaggtcctgtataggcaagaaactagcagaaaaacaacttcaaataactttaggtgaacttgtgaggaattttcatgttactgtcgataactcggaagacgttgacgttatattggaaatggttgccataccgtcggagaaaattaagtttcaattttccaatttggaataactagaagatattacgtacacccgtatattaagagaatatccaacatatacgccaatccctttgtattttctcaccagtcaagaagtaataatgttactatacgacaaaaaggaaagcttctaatatattaaaaagtaaattatttttcgagaatac

SEQ ID NO: 265 - DNA, 1442 bp, Rhynchophorus ferrugineus
cattcagctgagcaccggaactcttatttgtacgtttttgattatcagaccaagttcggggattatctgcagaggcagggatgtattcacggcgaggagctgccctacttgttcggcgctcccctcgtcgggggcttcatgcattttggcagaaactacactaaatcggaagtaattctctccgaaattaccatgatctactggagcaattttgctaggacagggaaccctaacgaacaacaggataacgaccataacaatagacaagatcgagctaggcttaagaacgttgaatggactgcatatgaggctgtacataaaaaatatttaaatttagataccaaagcgaagttaaaaaatcactatcgtgcacatcggttatcattttggctcaacttggtgcctgatcttcacaaaccaggaggagacgacgttccttcttctcatcacgagctaatagatgataacgaacctctgccaaaacttccgtccctcaatcctcgtaaattaccaaccaccgaaagcccagaattcagaacattagtcggcaacggaacttccattttagccacgattagttcagctgactccaccgagagagttgaagaactaggtggtttaagtacaacgcaacatcctgtcgaagatggtttcgccgcgtattctactgccttaagtgtaactatagcaatcggttgttctctattaatactaaacgttttaatattcgctggcgtctattatcaaagagacaaaacacgtatgaacgaaaacggtagtcacccgcctaaaaaaagaaacgaaaacggccagatgcccaacaatatctgtggcgacctagaatccagcataatcggcgtcaaaggtgattcggccactatattaggtcatcatcattctcaccatcagcttccacctccggaatttgcggatttgcctcagaataacgctacgcttcccaggcacgctccacctccaccgaaactgggtaaatccaacgtaaacacgttgagctcgcgaggcgttcaagaaaaccaaccgttgctatcaacgcatagcatacagttaataaacaccggtacgcttaccaaaaagaacacacagatgaacgcgaaacagaacactaacatggaggaactgagggtgtgacaacaagatgtttatttgtgatttgcgatcgctgttgctcaaactgaactaatcctggaactctcagtgttgtttttagtgcgcggtattgctgaacttgtaaagtttttctaatcgtctttttttatcgaacttataacacgattgtcacacggtgaattctagagctgctattttcatatgtaatcagaagtaattgccgtcgatttacgccccatatcattttagaaaatcgacaacttttaaatgtgtgtttgctgcaaaaccagaatactgtaaaaattcaaatcccc

SEQ ID NO: 266 - DNA, 724 bp, Rhynchophorus ferrugineus
aatcgttaaaaacatttgcataaagaaatacttaattacttaacataatgttacataattatttggaaaaagtattagctgaaatcttagaagtggtaggccctgagagaaatgtatgtgtggatgatttgccacatttaaaatttttagaaagggtcattaaagaaacacttagagtatttccagttggtcccattttggctaggactttggacggtgacattaatgttggcgatcatgtactttcgaaaggcggatcgatctgctttggagtactaagattacacaggagtgagaaatattggcctaacgccttgaaatttgatccagatcggtttcttccagaaaatgctgcaaaaatccaaccaggctcatatgtaccgttttcttacggccccagaaattgtttagggctcagatacgcaatgatgactatgaaagttatattagcaacaatcttacgcagatataaagtatttactgattataaatctatagaggagattgatataaaatgcagtgttatgacccgcccaattaatggttataaattatattacgaatcaagaaaatagtaatagcctccttcgagatggtgttattttgggatggtccttaaaatgtttgatggaaatagtaaatacataataattagcgcctagttttaaaaattttgttaataattaatacaatgtatctttttataaaattattttactttaaa

SEQ ID NO: 267 - DNA, 523 bp, Rhynchophorus ferrugineus
aatcgcgtcactaaagatacctataatactttagtaaagcttatcggagatcgactttttcttagtgacattgaaacatcagccagactacaaagtatcgctaccgaatctgacgttttcagttatgcatactcatacaggggagcagtaagcaaatccaatccaagaacaggctctaatgtcgatataggttgctcacatggagatgacaccatctacattttgaagactgacttggatactctttctacagaccaggacaaacaaatgagccaaatttttgtcgatttaattacttcatttatgaataaaaccgtgccgaacataacagaatggaaaccagtatccaaaacacctgaagcagagttcgcccagctgaaaatcgacggccctacagaaacagccatggtatatcggacggaaatcggcgagagatctttctggcatagtctaccattccgtgaaaatcatttcctggatgttattatcgacaaggacgaattgtagtttattattaatacgg

SEQ ID NO: 268 - DNA, 363 bp, Rhynchophorus ferrugineus
atcaaactacctgcaatgctaaacttcagcatttttatacacggtttccatcacaatccgcaatattacccaaacccagaaatattcgatcctgaacgattcgccaattcgaaaaatattgataaaatgacctacttaccatttggagttcaacccagacagtgtttgggaaagaacttttctatgttagaaatgaaatgtgccttatcgaaaataatacgaacttacgagattataaacatcgcagaacatcaattggagatcaaaccaaaacttgtgttattttctatatctggtatatgggtgaagattcgaaaacggtataagaaagtatcaaaattaggtttaaataaaactacagag

SEQ ID NO: 269 - DNA, 497 bp, Rhynchophorus ferrugineus
gagtgaacacgaagatgacaactacatttctataataggagatgcttggttcgttgttggaataattggtgccgttcgaaatcatgctcagacatcgccgtttcaaatttatttctataaactgaacttggatacgaaacttaatgtgttgaaggcgtttgttaactgttcagatgttcctggttgttcgcatggcgacgacataggataccttttcaagagcgcaatgaccccaccgatcgaacctaacacaatagaagagcttagtctgaggaggattttgagactctggtccaatttcgcggcctatgggaacccgacgcccgaagagagcgaattgggagtaacttggaaaccagtcatggcgcgtcaacttaacaccttaaacataggggaagatttaactttagaaattaatacggatgcgaaaagggttgatttatggagagagatatacagccaatctccgtctacttccaaatatttataagcctcct

SEQ ID NO: 270 - DNA, 435 bp, Rhynchophorus ferrugineus
cggaaatattggcttaaaagatcaacttttcgccctagagtggatacaaaaaaacattcaatattttggtggagaccctactaaagttaccatattcggacaaagcgcaggagcatcatcggtttcttaccaaatactgagtccaaaatctcaaggtctatttagaggggcaattcaagaaagtggatctgcattgtctccgtgggcctatcagagaaattcaacaaaaatatcgtatttaactgctcagtatgtggatacaaactacagcggtactacatcgcaggaattactcgacttcttgcgttccgttcctgcttctgcgattgaccaggcctcggcagctttaaataatgactacgcggattacaataatttacaagtatcaaaaggtttcctctacacgcctgttattgaggttccccatgacggagc

SEQ ID NO: 271 - DNA, 215 bp, Rhynchophorus ferrugineus
ctacggtactgacgaagacggaaacgactactggatcgtgaaaaacagctggggcaccaagtggggcgagaagggctacgtgcgaatgactcgcaataagaacaaccagtgcggcatcgccaccgcggccagctatccaatggtttagaagatatcaaatggctaactcaacacaggcactcctttgaaggcgtgatgagaagcagcagatcaat

SEQ ID NO: 272 - DNA, 362 bp, Rhynchophorus ferrugineus
tgatcggcacctcgtacgtcgacgagaccatcgccacgggctttggcaaccacctcgccaggcccatcatgcgcgaaaagcaccgcccggacatgaccctcgacgaggccaccgcgctcctccgcgagtgcctcgaggtctgctactaccgcgacaaaaactcgatcaacaagttccggctcgcaaacgtccccgccgccggcgtcgacgtctcggaacccttttccatcgacaccaagtgggactacgccctcttccgcgacccctccaagaacgcaccgggaacctggtgaaggggggaggcgaaacaacaccgcaaacccacacacatacacaccacccaacccgtctccctctctccc

SEQ ID NO: 273 - DNA, 431 bp, Rhynchophorus ferrugineus
gggtgtacggaccatctcaatttcaaataaaaggcatcagaatagaacttgataagggcgcactccaaattaagttatttttgcccaagttaagtgttaacgcctattacaacatgaatggacaaataatgatgatgcccataaatggagcaggtctgagtttaggcaactacacaaacattgatgccatcttaaccatgaaggcacgcaatatacagaaggacgaagagatttattttcacatacaagactgtacggtcgatttcaatatcggtcatgcccaattgtatttccaaaacctctttaatggaaacaaagaattaggtgacgccatgaactcctttcttaataataattggaaaacggtctcgagtgaaatcaaacccatattggaagatcgcctagctgaaatatttaaaaaatttgccaac

SEQ ID NO: 274 - DNA, 241 bp, Rhynchophorus ferrugineus
tttgaattctggtacgaagactcttgttcctttatctgaacagcaattagttgactgtagctctagctatggcaacttaggttgtgatggtggcttgatgaccaacagctttgagtatgctgaatctaacgccctttgcgagcgttcgcattacttatacactggtgtaagtggtgagtgtaaggccaagaaatgtgatggtcgtgtcaaagtgagcggctttcatgaggttgaacctaat

SEQ ID NO: 275 - DNA, 446 bp, Rhynchophorus ferrugineus
atctcgaaatgattctgccaattatagtaattgcactcctctcgttatactactacagcacacgaaatttcaattattggcaaaaacgcggcgtcaaacatgataaaccaataccaattttcggaaatgacctcgaccggaatcttctacggaaaagtatctcgcaaattgcagaggaaatgtactggaagtatcccaatgaaaaagttgtgggattttttcgttgcaatgcacctgaattggtgatcagggacccggaaataataaaacgtgtactggtgacggatttcgactatttttatccacgcgggatcaatcataaggaggtcgtggagccattgttgaggaatttgtttttcgcagacggcgatttgtggcggcttttgcggcagaggatggcgccatctttcacgagcgggaaactaaaagcaatgtttcctctgata

SEQ ID NO: 276 - DNA, 437 bp, Rhynchophorus ferrugineus
agtggtgtcattggttgcccttttactttatataaaacataaacaattgtattggaaacgacgcggtttatatcaatttaaacccgaatatttcttcggcaatgccaggaaagaattattcggtctaggttccattttcctgttgtttcgcgacacttacgaaaaagccagagcgttgaaagaaaaacatttcggaatatatttcttctgggatccgctttatgtccccaccgacttgaacatcatcaaacacatcttaataaaggattttcaacatttccacggccatggttggttctcgcatcccaaggatcgcttgtcgatgaacctattcgctatggaaggcgaaccgtggagagtgcttcgagcgaaactcacgccgacgtttacgtccggaaggatgaagatgatgttcgatactttagtggcgaagacgg

SEQ ID NO: 277 - DNA, 256 bp, Rhynchophorus ferrugineus
agatgatccacacgatcgagtttgtcctgggcgcagtctccaacacggcctcctacctccggctctgggccctctccctcgcccacgcccagctctccgcagtcttctacgacagagtcctcatgaacgccatccgctccggatcgcccgtcgccctcttcatcggctttttcgtcttcgcctttgccaccctcggcgtcctcatgggcatggagtcgctctccgcgtttctccacgccctccgactccactgggt

SEQ ID NO: 278 - DNA, 538 bp, Rhynchophorus ferrugineus
gggcactgggcgaagaaattaagaggttttacgtgggagacctatcattttccgaaaatttggccgaaattctaaactggtatagtgaccagttatttgtcaggtctagctacaaacaggcactagttcagtcatcctactctccagtttatttctaccagctttctttctatggttcaccgagtcagggaggccttttagtaccgggggctggtaaagttggccatgcagcggatctcgcatatcttttcaatactactgggatgagtttgcaaaccgaagctgatttcgtaactagagagagaatggtgactctctggaccaattttgtgaaaacatcaaatccaacacctcccaatagtcattccgatgttctgaaaaacttccattgggaacctgttagtgccaataattttcagattttagatataggcgatgatcttcaaatgactcctactcgaaaagtgactgacttggttttctgggactatatttgggatacctattcgtacagaccgtataataattattaagtata

SEQ ID NO: 279 - DNA, 414 bp, Rhynchophorus ferrugineus
tgacgatttagatcatggtgttgctatcgttggttatggcactgatcccgagtcaaagactgactactggattgttcgcaactcttggggtactgactggggtgagaaaggttacgttcgtttcgctcgtaaatcagacagtgattcgggtgtttctggtatttacttgatgggttctttccctgaagcttcgttaattacacccaactcgactgttgtggctcctttgactcctgatcactctgttgatgacgcgatgcatgtggaggaagaagctgcttcagaagaggttgttcgcatttaggttgtttctgaatggtttaatttttttttaaattttacatcagggatttattttttttgaaaattgctttcacgtttttcaacattttacatcgtctgttttgatttccg

SEQ ID NO: 280 - DNA, 307 bp, Rhynchophorus ferrugineus
gtttgtaactcgacatagtttttgagtgacttggaaatggcgagtcagacacaggggatccagcaattgctggctgctgaaaagcgggcagctgagaaagtttcagaggcgagaaagcgaaaagcgaaacgcctaaagcaggctaaggatgaggcccaggaggaggttgaaagatacagacaggagcgcgaaaagcagttcaaagagtttgaggccaagcacatgggcacccgggaaggtgtggccgccaagatcgacgcggaaaccaaagtcaagatcgatgagatgaacaaaatggtgaactcac

SEQ ID NO: 281 - DNA, 540 bp, Rhynchophorus ferrugineus
gaataccgtatgcgaaaccaccagtcaacgacttgagatttgagccaccagaagatatagaaccatgggaaggtatatggaaagcgactactcaaactaggtgcatgcaatatgatcactatcgacaagattccgatgataattacgtagttcatggcgatgaggactgtctttacattaatgtctacactcacatgttgggtgaaggcgccaacatggacgtcttggtatttattcatggaggtgccttcatgttcggaagtggattcagttacggaccggaaattatcatggatagaaaagtggtattcgttactttcaattacagactcggtcctttaggatttttaagtactgaagacgaagagctaccaggtaatctcggtttacgcgatcaaatcaaagccttacagtgggtaaaagaaaacattcaatattttggaggaaatcctgaatccatcaccatttttggtctatcagctggtggtgccagcgtacattttcactatctttccccggaatctacaggtctgttcaaag

SEQ ID NO: 282 - DNA, 357 bp, Rhynchophorus ferrugineus
gacttttcagtcaaaaatcaataccaaaatggcgacgaaatagaaaatttattacaccagcctttaattcacaaatgttaaatagttttatggaagtatttgttcaacgatctaatgaactaattgaatttatgagacagtatgaaaagaaaaaagatgttgatttatatgatttcctttcccgatatgcattaaaaacaatttgcgacactgcaatgggagttaacatagacacagaaccagaaggggacagttttaaccattggatagagagagccctggaaatattaatagaaaggatatttaatatatattatcaaattgatattattttctgcaattcagcattaggcaaag

SEQ ID NO: 283 - DNA, 289 bp, Rhynchophorus ferrugineus
cttaggtcaagaggtcactgcaccaaaaagtatcttagagatccttattgaatcaggaggagataatggttttactgatcttgagctacaagaagagactctagtaatgttgctagccggcacggacacttcatctgtagcgatctcgttcacagcactcctgttagcaaaacacccggatattcaggacaaagtgcatcaagagattaaagaagtcattggagatacagatagaattattgaatcaaatgatttgccgaaactgaaatatttagaagcagtaataaag

SEQ ID NO: 284 - DNA, 410 bp, Rhynchophorus ferrugineus
actacaccctggacggcaggctcatcatactgcctgtgcagggggaggggaaattcaccatcaccatacaggacattttaatcaagacgctttcggagctggagacagttcagggcagcgacggcaagccgcattggcacatctcgagctggacgctcaagtacaccaccaagactggcgcacatttccagtttgacaaccttttcaacgggaacaaaatccttgccgatccagtggatcaattcctgaacagcaactggcaagaagtgatgcaggaggtggcgccaccagtcgtacgcgctacagtccaaggagttatagattcagtagaagctctttataaggcggtgccagctgaagagttgtttattaaataaataataaatgttagttaagtagtttgttaagag

SEQ ID NO: 285 - DNA, 479 bp, Rhynchophorus ferrugineus
attcagtgttatattatattcgcgaccataggttggttctagtgagtttctgttaacttgtagctgttttaaaatgtctagcgtttttgtgaccattaaggagggaaaacttcgtggaacaacagggcaaaatcatgctggtgaacctatttatgagtttcatggtatagcttatgcaaaaccgccagtaaatgagttgagattcaggcccccggtaccagtggaaccttgggagggcaccaaagatgctactgaacccgtaatttcatctgtatcgccgaacatagctactttcgcacaggaaggatcagaagattgtctagttttaaatgtctatactaaaaatttacctagtgagaatactcagaaaaaacctgttatggtttatattcatggtggtggtttagttttgggatcttcaagccgtaagtcatatggtccagaatatttattgttggaggacattgttttggtaacac

SEQ ID NO: 286 - DNA, 350 bp, Rhynchophorus ferrugineus
cgtcgaccagctcggtgttgacaaggtcctcttccccgaaatcgccgccggaagggcgcggtacatggcctacagcaagtcccagctcatggaacgcaccaagatgggcgacgacaccgaccgacgcgatttcttctattacctcctcaaggcgcgggatcctcacactggcaaaggcttcacgactcccgagctctgggccgagtcgaaccttctcatcatcgccggctccgacacgacctccacagccatggcagccaccctcttctacctcgtccgcaacccctccgccctcgcccgcgtcacccaggaaatccgctccacattcaccgacgtcgaagaaatccgcc

SEQ ID NO: 287 - DNA, 304 bp, Rhynchophorus ferrugineus
aaatattagatcctgtatggatcgataaagtcgatggctcattaactattttgcattataaaatcgaaaatgctacagttcgcggttatgctgattgtcacataaaacatctaagtatcgacaaaagtcagtcaagtttgaagttcaatttactttgtccggaaatagtcatgatcggtaactacgaaatgaatggccgattgattgttctccctgtggagggagttggaaactttactttgactatatattcttataacatacattttgatgtggaattcaagattgtgaagactgatgacgg

SEQ ID NO: 288 - DNA, 410 bp, Rhynchophorus ferrugineus
gtcctaccaggacaaagtagaagagactaaaaggtttgctatattccaaaacaacctgaagaagatcgaagaacacaatgctcgctacgaaactggagaagagacctaccaaatgggcatcaccaagttcgctgatatgacctccgaagaatttggagccatgctaagggcctcttacaagcgtaaaccaggcacccgtgctgtataccaagcgcccgccgatgctgacattccagccagcttcgactggagaccaaaaggtgtattgaacgcagttaaagaccaaggaagttgcggatcttgttgggcttttggaagtattgccgtagttgaaagtgctctggccattaaaacaggaaacctattatctctctctgaacaacaactagtagattgtgctaggggaggta

SEQ ID NO: 289 - DNA, 295 bp, Rhynchophorus ferrugineus
cgaagattgggcctagagataatatggagaagctcattattaaacacgttaaggaatttgtgcggtatatcaagacattagatacaaaacagcctatagatcctttgagaccactaagacactgcttgggatcaattataaacgaaattgtgtttggaaggagctgggaacgtggtaacgagacatgggaggagcttcaagaacttcaagaggaaggattaaaatatattggtatagctggtccattgaatttcttaccattcttgaggtttttgccgatgtttaagcgaccaat

SEQ ID NO: 290 - DNA, 441 bp, Rhynchophorus ferrugineus
atagaaggtactactgacaccacttacaaaaataacacattctttcaatttgagggtataccatatgcgaaaccaccgataggtgatctaaggtttgaggaccctcaagatccggaaaaatggagcggagtacttaaagctacagtggtaacactttgccaacaatatcaccaatacaacgtcgatgaatccggaaattacgtcactgaaggagacgaagactgcctttactacaacctgtatacccccagcttgaaccaatcagctaatttagacgtgctggtatttattcatggcggagccttcatgttcaactatggtggtgtctggagaccaaataatatcttggacaagcctctagtcttcattactatcaactatcgtttaggacctttagggtttttgagcacccaagatgacgtcatacccggaaattacggc

SEQ ID NO: 291 - DNA, 299 bp, Rhynchophorus ferrugineus
cgaaggattatatccagctaacgcgttttataaaggagaaacatatctggaaaccatcgacaagagatggaatgagctaatgccccatattctcatgtacaatttcaccgtcgatcctgaattaaaggacatagtatcaacaagcattcgccaaaaatatatgaaaaaccgagcagtagaacgatcaacattcgaagacttcgtagaagcgtgtggtgacagaaacttcttaaacgacatggataaagctataaaactgcacagtgcaggaattgaatcaccaatgtggttgtttgcat

SEQ ID NO: 292 - DNA, 224 bp, Rhynchophorus ferrugineus
gaatgtttcatagaagtttaagagatactgtttttcttgcattaagatttatgttcccagaaattacaacaagtttgaccttagtggctccggaattacaagaaatgattaatcaaatagttaagacagtaataaatgaaagaaataataaagcttcgggaagaaatgattttattgatttactgttggaaataaaggaaaaaggaagtatgattggagaatcg

SEQ ID NO: 293 - DNA, 666 bp, Rhynchophorus ferrugineus
ggaaaaaggaagtatgattggagaatcgttggacaaaaaaaatccagatggtacaccaaaaacagttgaatttgaattagatgacgttttattagttgctcaagtgtttgtattttttggagctggatttgagacttcatcgactgcttcaagcttcattttacatcagttggcttatcatccggaatgtcaagtaaaagcacaaaatgaaatagataaagttcttgcaaaatataataataagctctcgtatgaagctatcaaagagatgaagtatttagaaatgacatttaatgaaggtcttagaatgtatccctctgtaggatatttagttagagtgtgtagtgtaccagagtatacattccctgacttaaatttaacaattgatgacggagtgaaaacagtaataccaatagcggcgatacaaatggatgaaaaatattttagtaacccggagaaatttgatccggaaagatttcgcgatggggccaaggatgacattaagaaaggtgtatttttgccgtttggcgagggacctagatcttgtgtcgctgcaagactggggcaaatgcaggccatggctggtctagctgcggtgttacagaagttttccgtggagccagcagcctgcagcaaattagtgcctgatcctgacccagctgggct

SEQ ID NO: 294 - DNA, 277 bp, Rhynchophorus ferrugineus
agtcccacttttactccagtcaaaatgaaaaccatgttcgagggcgttaagaggtgcacggtaccattaattcagtgtttggaggaatcggtcaaaaatggagaaatcatcgacataaaagacgttatgtcggcttatactatagacgtgataggagctaacatctatggacttcagttggaaagtttcaaggctaaggactcgaagtttcgcgaaattggccgagaagttttcaacataacctggatgaaagggatcaaagtgatatttttccgca

SEQ ID NO: 295 - DNA, 231 bp, Rhynchophorus ferrugineus
gattgtggttacccttaattttagattgggtattttaggttttttaaaagcgggacccgaggaaggacaaatacaaagtaattttggtttaattgatcaggtagcagctctgttatggattaagtcaaatatagaagcttttggaggtaatccctataatgtgactttaatgggtcacggtactggtgctgtatgcgccagtcttttaacaatcagtccaatggctatgca

SEQ ID NO: 296 - DNA, 337 bp, Rhynchophorus ferrugineus
ttaggcatgcatcaagatatacaggaaaaagtattagctgaaatattagaagtggcaggtgctgaaagaagtatgtctgccaatgatttaccagagttaaaatatttagagagggttatcaaagaaacactaagattatttccggttggtcccattttggctagaactttggacggtgacattaatgttggccaccatgttctttcgaaaggagcatcgatctgcttggctgtactcaggttgcataggagtgaaaaatattggcctaatgccttgaaatttgatcccgatcgttttcttccacaaaatgttgcaaaaatccaaccaggctcgtatg

SEQ ID NO: 297 - DNA, 488 bp, Rhynchophorus ferrugineus
taaaggagtcactgagattatatccgccagtgccagttgttgtcagagcggtggacaaaaacattactttaccgtcaggaataactctgactaaaggcgtgtgcgccctgatccatatttgggcaattcataagaatccaaagtattggggtccagatgtaactcggtttagaccagaaaggtttctcgagggcccattgaaacacccgtgtgcctttgtgcctttcagcaatggatctagaatatgtttaggttatcaatacgccatgatgtcaattaaaacagtcatggcacacctgatacgacggtatagaattttaccagcaaaagtaccgaacgacgtcagaaaagcgatggaatctgatgatgatgacgctctacctttaacctatgaacttatgataaagcatgcaggcaattttgaattacaattagaattgaggacttaataggtcttcgaaaggtttttataaaccacccaatcggct

SEQ ID NO: 298 - DNA, 547 bp, Rhynchophorus ferrugineus
ctaaactgttgaagccagaagtgaagattgtcggctacactgctcttccaacgaacaatccttatgccgtcatgctacatctggctgacattggtcctttgtctattggagtggacgcatctaattggcgcagttactccggtggtgttttccatggttgcgataatcctgatggcactgttgatcaaaatcatgctgtccaattagttggttacggtgttactgatgacggcgagcctttttttcaagttcgcaactcttgggggacagcatggggtgagaaaggttttattaagattcctcgtgaaattcctgatgatgatggtaacattgagacggttaagtttattgacaacacgcctctcgacggaagtggttgtatcatcgatcccaaaggaacagagccagtcgtaatggcaggccattgtggtttgtattctggccctacatatgtcaatgtcgttgagccaagtaaggctcctaaaaatgattaattattttaacggattttaacggattttatcggattttaacggattttatcgga

SEQ ID NO: 299 - DNA, 382 bp, Rhynchophorus ferrugineus
tgaacatcacacctctggttcgcgacccccgtgtggcgatattgtgccaacgcccaagtgtgtgcaccagtgccaagcgggatacaaccgaacctatgctcaggacaaacactacgccaccaaggcatacaccgtgctgagcaacgagaagcaaatcatgaaggagatcatgactaacggtcccgtggaggcggacttcaccgtgttcgccgactttgtgcagtacaaatcgggcgtctaccagcgccactcggagcaagcgctcggcggccatgcgattcgcgtgctcggctggggcgtggagaagggcactccctactggctgtgcgccaactcgtggaacaccgactggggcgacaagggcttcttcaagattcttcgg

SEQ ID NO: 300 - DNA, 270 bp, Rhynchophorus ferrugineus
cggcagaggcgcggggtaaaacaaatgatgggacagttcctcctgggcaaaaaacattgggagaatggctcttaaatcgatataaggaaagcaaacagatgaacatcaaatatcttggagtttacttatttcactcgcctggattgatagtcatcaaccctgccttgatcaaggacattatggtaaaagattttgcatatttccaagggcacggcgcctattatgaacctagagatgtcctctctatgaacatctttaacttggaaggcc

SEQ ID NO: 301 - DNA, 283 bp, Rhynchophorus ferrugineus
ctatgtttcaccttataatatctcgagcagaaaaacttcaagccataactgatgaaataacagaaagagattattatgacgcaagagagttgatggcaaggtatacaacagattttattggtgaatgtggtttcggaataaatatggatacgttatctgatgaaaacaaccaattcagaagactcggaaaaagaatatttcacaaaacgcttagggataagatatgttttgcattaaaatttatatttccagaatttgcaaaaaacttgaacatattagcgcc

SEQ ID NO: 302 - DNA, 359 bp, Rhynchophorus ferrugineus
cggcaatatttctctatttgaaaaggtgaccaagtattctatggattccgtatgtgaaaatgcacttggggttaaagttaactctcaaagaatctcgaaccatcccgtgcctaaagcattctacgaattttgtaatatagtttcttaccgaatggtaaatccatggctttattttaattttgtttacaaattgcattggcattgcaaacaaattgatgctgcgtcaaacatcatgaaagaatatgtatcaaagattattaagtcaaagcgacttagtatcaaagagcagaaaaataaaatatcgaatgaagattaccctgaaagtagtactacgagtaacttaggtcaagaggtcactg

SEQ ID NO: 303 - DNA, 589 bp, Rhynchophorus ferrugineus
cctgttactgtccctgtctaagatagcgaaaggaatgcccagcgcggtcattgccatgtcgggcacggcgatatctcaatgggccgtggacgatgccgccgccaatccggcctataaaatagccgaggagagcggatgtcccacgcaaaatgatgtcactatggtcaggtgcctccagcaggtcccagccgagttaatcataaagcgggactccactgttgaattccagaaattgcagagcagaggcttcgtctctggaatgaacggccgactgggagctagccccgtgatggaaggacgagacgacggtcgctccttgccaggtttcgtggtccaggatcccatcgaggccgcgtacgcacgcagcaatcccaggatcccacttttaacgggagtgacgaaggatgaaaccaagagagccgttcatggtccgtttaagaaggacatcgtcaagggactgtcgtcgatacccgacttcctcactcaggtcctggccaaggagctccgaaacaacattgtcctcaaccaattggtgggcaaggagggtttgttggcgaacatatccaaggacatcgagaggaacgtggac

SEQ ID NO: 304 - DNA, 328 bp, Rhynchophorus ferrugineus
aatacgagggcgtaaaagtcaaagtatatatccgagctagcaggactcctggtgatgacggtctcacttacctcaacctacaacagctcaaaatggacttcagcgtcaaggacatccgtatgggagtcgacggcatccacaatggcaacgccgttcttcaagcggcattgaatctgttcatcaacagcaactcgcaggagctcctcaaagagatgaagcctcatctcaagaagaaattgatagcgcttatgagtgattttgtcaataatttattcgataaagttccttacgaagcgtttttgtcggacgagtagacagttgttgccag

SEQ ID NO: 305 - DNA, 256 bp, Rhynchophorus ferrugineus
ctgaaaacgccatgtcttactatcgaaaattcaaagctatgggtgtacgatttggaggagtgtattcagaaaaccgaccagaatgggtaccggtcgaccccgagctaataaaaacaataacaacgaaggattatgagtattttgatctccactttaacgaaataccgaagacgctgtttttcaataacctgttccatatgagaggagaagaatggaagaatatgcgacgaaagctaactccagtttttacaacggg

SEQ ID NO: 306 - DNA, 234 bp, Rhynchophorus ferrugineus
tggtttttggagaccgaataatatcttggacaagcctctggtcttcatcactatcaactatcgtttaggaccattagggtttctgagtacccaagataatgtcatacccggaaattacggcttgaaagaccagcaaaaagctctaacctggattaaaaagatggtcaggtattttggtggtaatccgaattctatcaccatccaaggcatgtctgcaggtggtgccagtgtcca

SEQ ID NO: 307 - DNA, 304 bp, Rhynchophorus ferrugineus
atttatcaatggatatgtttgttgttggtgctatacaactggcaaaactaatagcaaaacagaagaaaaataaggtgttcttttacaaattcacctgcaaatccgaaaggaatcgtcttgggacagtgtatttgggactgaaagaagtcttatttgagaataagcaggtggtatgccactctgatgacctggcttatttattccctttaaaatccatgttgaagaaagtagacgtgaattcgaggacatgtgaattaattgacaatgtccccagactgtggacgaactttgctaaatatgggac

SEQ ID NO: 308 - DNA, 264 bp, Rhynchophorus ferrugineus
tgaagcatggcttgcctactgaggaagactatggtggctacttgggacaggatggttattgtcatatcgacaatgtcaccctagtcacaagtatgaagggctgggtcaacgtgaccacaaacaacgaaaacgctttgaggttggctatcttcaaacacggtcctgtgtctgtggccatcgacgcttcgcacaaaacattcagtttctattccaacggcgtgtattatgatcctgaatgcaaaaacaagatagacgagctcgacc

SEQ ID NO: 309 - DNA, 351 bp, Rhynchophorus ferrugineus
gatcgtcatgtggtctgactggtccatgggtcgtgaagaatccgtttggggacctgatgcgatggaattcaagcccgaacgttggattgacgagtctggtcgtttgaagaaaatgtcacaattcaagtaccacgtcttcaacggaggacctcgtctttgtctcggtatgaatttggccatctatgaggctactattctcatcgcgaccatggccagagacttcgacttcaagctcaccgatagtttctggaagaatactactatgacctctcatttccctggggagaacactcccatgtaccgtttatctttgaccttgcccatgcttagtgcgttggaagttgacgtgac

SEQ ID NO: 310 - DNA, 301 bp, Rhynchophorus ferrugineus
gtttgctcccaaagatctggacaaattcttctccgaaacagtgttggataccattgaatatcgggagaagtacgacgttaggcgtaaagactttatggatttgttattgcagttgaaaaatgggagcgatgacgggaaacacccgcctgaatcccaaagattaaccgttgacgagataattgcacaatgctttgttttcttcttggctggattcgagacgtcttcgataacaatcacctttgctctattggaactggcatttagtcaggatattcaggaaaagttgagaaatgaaatcctc

SEQ ID NO: 311 - DNA, 301 bp, Rhynchophorus ferrugineus
acgcaatgcctccgctcctttggataagcgtggtgtgcctgattcagacggtgttatctctacctgctacaatgaaggtgaattcgctatgacttttgacgatggaccttactacggttctaacatcggtgatgccttcaccaataacaatgcacacacaactttcttcttgaacggaaataactgggattgtatctacgatcacgctgaagaacttcaaagacgctttgaacaaggccatcaaattgctgctcacacatggtctcatcctgatattgctactctcactatcgacgagccc

SEQ ID NO: 312 - DNA, 331 bp, Rhynchophorus ferrugineus
caagcttgaagttagtggtagacgatgtcacagttactggcttgaaaaactgtgttacaaaaaaaattcaacgagatccagcaagatcgtggctaacagtgaaaattctgtgtactgcgcagttggaaggagattatgagatgaagggaagcttgctcatcttacccattgagggaaagggcaaagtacatgttactctaaaaaaagtgctagtcaacatcgagggagaattgggagaaaaggataaatctgatggaaaatactggtccattaaaagctggaaaagtaattttgagctcaaagccaaatccgacttggaattcgagaattt

SEQ ID NO: 313 - DNA, 245 bp, Rhynchophorus ferrugineus
actagttcaaccgcaatatgtttggccctttatgaaattggtaaaaacagtgacatacagaaaaagcttttaaatgagcaacagcaactttttaaaaaggaaagtccacaaattgattatgaagtccttcaacaaatggtttatctagatatggtgattaaggaaactttacgactatacagcattgttccttcagttggaaaaagaatcaccaaagatctacaatattgtaatatcaaactacc

SEQ ID NO: 314 - DNA, 270 bp, Rhynchophorus ferrugineus
cctaaaagtaactggatttaaagatgtagtcattgaagatttttcgattgagaaagacactgaaacaacccatatgacactgaaattcaactacatcgctgacggtctagtagatattaaattcatcagcaaagataagatcattacaggaaaagtcaattacgatgctggtgtaactggcactatatcatacccttttacggcaaagactgaaaatggcaaagaagtatttactattggcgatgaaactgtaacctgcgaaactacaac

SEQ ID NO: 315 - DNA, 300 bp, Artificial Sequence
  Artifical
aacttgcctgttatggtatggatatatggaggtggatttgtgtctggatcatctgattataacacatacgcaccagattatattttggataaagacgtgctctatgtgtcttttaactatagattaggaatatttggatttttgagcactgaagatttagcagcgccaggtaattggggactgaaagatcaaattttggctttaaaatgggtgaagaagaacatagctcacttcggcggagatactagtaaaataacaatatttggtgaaagcgccggtgcagcgtctgtttcgtatttg

SEQ ID NO: 316 - DNA, 300 bp, Artificial Sequence
  Artificial
atggctggagctagattaattgtggagcgtttcgctaacattaccgatggatccatcattggcgtccgtgctccttatttgcgagtaggaggaaacaaacaatttgaaatgatgactgatcaattctttgtatatgacgcatcaatcaccgcatctttgggacgcgtaccaatctggccttacaccttgtacttcagaatgccacataaatgtaacggtaacgcccataactgtccatctagatcccatccagtttgggaaatggttatgaacgaacttgatagacgagatgaccctacg

SEQ ID NO: 317 - DNA, 300 bp, Artificial Sequence
  Artificial
aacccctatgcagataatggagggagcgtggtggcgatcgccggtgatgactttgtaattattggcgctgatactcgtcttagtgctgggttttcaatttacactcgggaacaaaataaactatttcagctatcccctacaacagtcttgggttgttcaggatgttggtgtgatacactaactttaacacgtattttgaactcaagaatgcaaatgtatcaacaagagcacaataaaattatgtcaactgaagcttgtgcacaaatgttatcaactatgttgtattataaacgattcttt

SEQ ID NO: 318 - DNA, 300 bp, Artificial Sequence
  Artificial
gaagatgttagaggaatgagagctccctttttatccgtcggtggaaacaaaatgttcaaaatgttgtacgattcgaactttacctatgactcatctatgcctatatacgagaataaacctccaagttggccctatactttggactacaaattgttccacgattgtatgataccaccttgtccaacaagatcatatccaggcgtatgggaagtacctatggtgatgtggcaagatttaaatggtggaagatgttctatgggtgacgcttgcagtaatcctcccgatgccgatggcgtctat

SEQ ID NO: 319 - DNA, 300 bp, Artificial Sequence
  Artificial
tgtggtgacattcatggacagtattatgatttactacgtctctttgaatatggaggatttcctccagaatccaactatttgttcttaggagactatgttgatcgtggtaaacaatcactcgaaacaatctgtcttctgttggcctataaaattaaatacccagaaaattttttcttacttcgtggtaaccatgaatgtgcttccatcaacagaatctatggtttctatgatgaatgtaaaagaagatataacataaaattatggaagacctttactgactgttttaattgtcttccagtt

SEQ ID NO: 320 - DNA, 300 bp, Artificial Sequence
  Artificial
atcgagaaagctaaaattcttattgaagaaggaggtgattgggatagaagaaaccgtttaaaagtttaccagggtgcttattgcatggcagtaagagacttcaaaacagcagctaacttgtttctggatactgttagtacttttacttcatatgaacttatggattataaagcatttgttagatatacagtttatacttccataataagtttaccaagaaatcaactaagagataaagttgtaaaaggttctgaaattttggaagttttacactcagaaccatttgtgaaagattatttg

SEQ ID NO: 321 - DNA, 300 bp, Artificial Sequence
  Artificial
agtttcacctagaggcgctggttacttgtttggatcagatgtagtggctcaattcaatgcagcgaatgatattgacatgatttgtagagctcaccaactcgtaatggaaggttacaaatggcattttaatgaaacggttttgacggtttggtctgcaccgaattattgctatagatgcggtaatgtagctgcgatattagaactaaatgaacacttgcaaagggacttcacaatattcgaagcggcgccccaggaagcgagaggaataccatcaaagaaaccgcaagctgactatttcct

SEQ ID NO: 322 - DNA, 300 bp, Artificial Sequence
  Artificial
actcgtggttttggggttcgaagaataacgccagggaggtagttaaagccatgggaattcaagtccagaccgaagcggaagctgtgaagattcttcgagctgtcccagcgattgatattctgaacgcacaagataaaatacctgagtcgttgtttccaatggtacggagaccattctccgcggtggtagaagcacctaatccccatgcgttcttctctgagagtccagtggacataatcaagagtggtaattataatcacgtgccggtcatcattggttacacggacacggaaggatacc

SEQ ID NO: 323 - DNA, 300 bp, Artificial Sequence
  Artificial
caagccggccttacttctgtggcaatcaaaggaatcgatacggccgtttgtgtgactcaaaggaaaattccagataaattagtagatgctaataccatcactcatttgtttcagttaactgacaatataggatgtgttatgactggaatgatagcagacagcaagtctcaggttcaaagagctcgttatgaagctgcacaatttaaatacaagaatggttatgaaatgcccattgatgctctatgtagaagagttgctgatatttcccaagtttacacacaaaatgcagaaatgcgtccc

SEQ ID NO: 324 - DNA, 300 bp, Artificial Sequence
  Artificial
tgcccgctaaagatgtaccacagatgatcactgttacttttgatgacgctattaataacaacaatattgaactgtacaaggaaattttcaatggaaaacgtaaaaatcccaatggatgtgacatcaaatcgacgttctttatctcgcataaatataccaattactccgccgtccaggaaatgcatcgtaaaggtcacgaaatagccgtccattcaatcactcacaacgatgatgaaaatttctggtctaatgcctccgttgaggactgggctagggaaatgggcggacaaaggctgataa

SEQ ID NO: 325 - DNA, 300 bp, Artificial Sequence
  Artificial
gctagccttgaccattgcgacttcccggaacttttatcgccgggtaacgtagccacgtatgggggactgtgcgctttggctacattcgacaggccagaattacagaaacacgttgtgaacaatggaggtttcaagcccttcttggaactggaaccagcgctccgcgacgccatcttaaagttctacgagtcgcggtatgccgcctgcttaaaactcctggacgaaatgaaggattcccttttgttggacttgtacttggccccccatgtccccgccttgtactcccagatccgaagcaga

SEQ ID NO: 326 - DNA, 300 bp, Artificial Sequence
  Artificial
cagctggtgggactatcggatgatttgggtaagctggatgggtttgtagaacaggttacaagaaaagtggcatcctatctgggcgaagttctcgaagatcagagggacaaattgcaggagaacttgatggcgaacaacactgatctaccaagttatttgacgcgcttccaatgggacatcgccaagtaccccatcaagcagtcgttgcgtaatatcgccgatatcatcagcaagcaagtgggtcagattgatgccgacttaaaggccaaatctagtatttacaacaccctgaaaggcagt

SEQ ID NO: 327 - DNA, 300 bp, Artificial Sequence
  Artificial
aaggtggacattgcccctatttggatcaatgtgttttacacaatcatgatcctgaagatgtatttgattggttgcaggaagatttcttgagatattatgatcagaatagggctccctatatgatgccattccacacaaattggttctcaattaaggagctagaaaagggacttgaaaaattcttagactgggtggctacactagatgacgtatggtttgtcacagctacacaagccctgacctggattactgatccgaaagacgtaaagcaattaaaaaattatgatgcctggggttgct

SEQ ID NO: 328 - DNA, 300 bp, Artificial Sequence
  Artificial
ggtaaagagtacctcggcccagactatctaatggataaagacattatagtcgttacatttaattatcggttaggggtatttggttttctgacaacattagatgacgaggctcctggtaattatgggttcaaagatcaagtattagctctgaaatgggttcaaaggaacatcgaatactttggcggagacaaaaataaagtcaccatcgctggacagagtgccggggctgccagtgtacatttccatttattgagttccgaatcggaaggtcttttccaccaagcgatttctcagagtggc

SEQ ID NO: 329 - DNA, 300 bp, Artificial Sequence
  Artificial
aagttcaaaccaccgccagaaatgagctgaatgaaatttttggaaatgacaaaaataaagagacaactctgcaagacatcaacgaaatgaaatatctggatttggtaatcaaagagattcttcggctttatccacctgtacctcatattattagaacagtaaatgaggacattaaatttaaagatcatataatccccaaaggtactgatatagcactattcatatacggtatcaatcgagaccccgattatcacgacaatcccgaagcttgcatacccgagcgccatctagagaagaaca

SEQ ID NO: 330 - DNA, 300 bp, Rhynchophorus ferrugines
tcacctcaaacagttgggctttggaaaggacaatgtagaacagatggttaaagatgaaatcagagatattataacaagaatggaacataacttaaacaatgtcaatattgcagaggttctagcaccatcagtattaaatattttatggtatttaacaagtggcaaaaacttaagaggtaatcagcgtgtgactaatttgctagaactcttgcacagaagatctaaagcatttgacatgtctggaggtatgctcaatttatatccatggctaaggtttcttgccccagataaaacggggtt

SEQ ID NO: 331 - DNA, 300 bp, Artificial Sequence
  Artificial
agagttgctaccgcaaaccaaatgttaaagcaattcctattccgttatcaaggttatattggagcagcattggtattaggaggtgtagattctacaggtcctcatttatattgtatttatccacatggttctactgataaattaccttatacaactatgggttcgggatccctagcagctatggctgtatttgaatctcgttggaagccagatatggaagaagcagagggggttcaactggttagagatgctatagccgcaggtatctttaatgatttaggttctggttcaaatgtggat

SEQ ID NO: 332 - DNA, 300 bp, Artificial Sequence
  Artificial
aggttcagctacggttggtttaaaaagtaaaaattacgccgtcctcatagctcttaaaagagcatcatctgaactgtcagcgtatcaaaagaaaatcatctgtatagatgatcatattggtgttactatttctggtttaacagctgatgctagaatattaagtcgctatatgagaagagaatgcttgaatcataaatattctcatgatacgtttttatccttatatagacttatttcaactttaggaaataaaatgcaagtttgtactcaaagatatgatcgtcgcccatatggtgtggg

SEQ ID NO: 333 - DNA, 300 bp, Artificial Sequence
  Artificial
cgttccagatctccctattttgttaatttacttcttgctggatttgatgataaagaaggaccccaattatattatatggattatttggcttctgtagcaaaagttgactatgctgctcatggttatggtggatatttttcgctttcaattttggatagaaactatgtgaaagtcatgactccagatcaagggtatgatttaatgaaaaaatgtgtgcaggaaattcagaagaggctaatagtcaatcttcccaacttcaaagttcagattattgataaaaatggcatcagggatatgcca

SEQ ID NO: 334 - DNA, 300 bp, Artificial Sequence
  Artificial
tgtggcgatatccatggtcaatacactgatttactacgcctgttcgaatatggaggtttcccacccgaagccaattatcttttcctaggagattatgtagatcgtggtaaacaatctctcgagaccatttgtctcttactcgcgtacaagatcaaatacccagaaaatttcttcttactccgcggaaatcatgaatgtgcatccatcaacaggatatatgggttttatgatgaatgcaaacgacgattcaacatcaaactatggaaaactttcacagactgcttcaactgcttgccgatc

SEQ ID NO: 335 - DNA, 7139 bp, Rhynchophorus ferrugineus
ctatgatatcccccagcttagaatataactttgttaatagaaactctggcccgcctaggcacttctccaacggcgcctccagaggatagtccttcaccaggtttattctatccaccaataatttcggctccaagtttgaaggcagcaaatcggccagatccggattgtaaatatttagcattttccaaattgtgaaataattttcaaagtcggacataaagcctgttgatagcaaatgttctacgtaactagaagaaagagttctgcttaggacgtccgctttgtatatacccaacacacaaagggacgcggcgaaacgaatccataaaatttcctttttattttcgagccccagatctctagcgtttcttatccaatcccttatggcgtcccaatggaccggtttgtagtcggtcagagctagagcaatcactaaactgaaacagtcgattggatggcatggttggtgaggatcgtcgtacaccagctttgacacgtaatccagcagatttttatgaaaatgacgtaatcgtgccaactgacgcatgacatacatcgaatttcttaagtttgccttcatttcgatgcactgattggcgaccgtgtcaaaaaacacttcttggtagtaaaacggataacttttcttgtactggtgggccattttgtaaagagtaaaactgatatcaaagaaactcagctgatcaacgtggactaccatatctgtaacgcttttcttatacagatcctcgatatcgtcgcgcttctgcagattgcacaatgatattataatacttttagctgtggacgcctcgaattcaccttcgtattttttcaaggcataaatgattacattcaaagtgtcactgcttaacttgtgtctaatagcataccacaaacattcggccatatgacttgcattacgtctatccatttttttcggaagataaatttcaaaaaccaaaggaaaagctataattaacgcctccactaagggagtcttttcaaaatcggatattaaaaattcgaggaacaaaatttgctggatgtttaatgagttgatgttatgccgaagcaattgcaataaaacttgggttatagtgctgttagaaggtactttaagatatgatatggtttttaatgcgtctataatatcacttatatccaacactccagaatgcactttaagttgcacacaaagtttctcgagacctggatgatttaaaatttttgttatcggtgtgctaatctgattatttttttgaattgcaaaaatggtttttaaagcccttacaacttgttcactgttcattttcttataatgatcactaactacttttagtacggcagccgatgttgtagctccagttaaataatcatcaataaaatcaactgttgttggctgttttgtttgttggccagagaatatatacattccttgggaaaaagaaacgttacgataagctcctgtgcgtttccataatgtccagggcaatttacaaccagctaacgtctttgacatgtttcttgttaaatctgttttggcacgtgaaatgagacctggatgtgcgctgtggacttctagattaaataagtatatcaaaatttatggtttaaacttttcgaaagaagatcatatagcattaataaaattattctatgaattagtaacaattcctgatctagaaccgaccagagttaataaatgtgcttttactttaacacaattattgaaaaaaaaatacttgctcactcgtgatgatcttcaactggaatggcgccctttatatgatttatgcacccgaacattagataaaagtaaatctgatataggaatgtacagatttttttcaacttttgactgcactttatttaatgcaataagaaattgtaaaatatatttcccagcttccgctacacaggaaattttagatgaatttaggccaaagttatgtccttttaacaattctgagatatccgaggcaataaggtatctagagttatttcttcctagtgctatgaaacctgaagaaacagatatagggtataagttatggttaaatgaatttatgaatctctgggaggtttgtcacaatgcaggaacctgggaaaataacatgatgtggatatttagtagcctcgctcgattccaaatgggttatatagattgggaaccgttcaccgcaaaaatgtttgtccgctttcaaagatgcctcaatttgccagttaatttcaaacagcgccagtcaggcaaacagcacaagatcgacatatcggccatgtccatctggatcgtgtgttccctgcactccaataacagcacgttctttcaccttcagaagctgatgcagaccctggagtcctatttccacccggctaacgtgggccgatgggccatcaagctgcgggagctgctgaaaaaactggcctatttcttcgtgcagagagtgcactccgaacgctacaagatcccatcctgggacaataacgtgcccgaccactttaagctcacggacgcggacatcgaccgtttcgtcaacatactgaagccctgcgtggagccggcgatgttttcccgcctcggctcgcaggatgtggctctggctctttcctatctggcgtcgctccgaccaaatctggtcataccgcctatactggacaaattatatgcctccatggatagcttgacggaacctcacaaactgacgtcttcgatgatggctgttatcgcggtggcaaggtatatggtgcagggaaaccagaagaactatccggaaggacccactcacgttatcccactcttgatggctctcctgccgggcatcgaccccaacgacgtccgcaagtcttacgtcaccttcaatttcatagtacacgtggtgaatatgatacccctcatcaattcctccgacgcgcacatgtactacgacgacctgaccgatgaggagcacatgatctgcgaagccaccgccggtttagaggatttcgtgctccagttcatcgacaggcttatcgtttgggttgaatcgagttccctggatttcattcgactagaacaaatggccagcaacaataattcgaagaatcggtccgaatctctggccgaaacggccctgaatgcagtcgttaacgttgtcctggcccaatgttctccttcgatatttcaaagtgccttaaagaagttttataatttcgtcacccagagggttctagaagtacaggtggccggcaagatggtcgccgtggtggcacgttgtttcgccgtggtcaatcccaaggagaccttgaaactgtttctgccgtatcttttcgataccatcgaagatgccctaaccgagaatcccaatctaaaccaagaagaacacgccgatgtgaaatttttgtataatatgttgatcttatctgagatcgttgatggcagggaagagcttctgccattcctggatcgaatatgtgcaatattggatagaacgttacatatgacatgtctggagggtagccatttatcagctaggatattggagttgattctgtcctctctaactaatgttttacccaaagaagcgaggagttctaccaaagactacagcgccccagtgaaggactttcttccgatcagagaatgggctcagcctcaaaaaatcaaagatttgaaaatagactggtatgtccccaaagaaaaggagatacaggccgtgcaaacgttgatcaacaaatatctcgtgcccgaaatcgatacactaaacaaatacgcttccggtgacgtgaaactgaccaggcaggagctaaaatgtaccttgaagatcgtcatttcggttctgtcctgccatctcctattgcccgtatgggaagaaccaacatatgaactagtcgattcggtgttggattcgtggagtttcaacttggtcgtcatcggaaatggtacggtttcgatgccgggcggtagcaatatacgaaaaaccgtcgttgataccattcatcgggttcagaagaagctgctggaaactgatgagggcgatactcagagcatccagcacataattaacgtatataacatcattttgttcaacaaaacgcggaaccaagacttcgaggttcactggaagatcttccacatcgctaaaaaaaacctcgaggaccgtctacaccagaagaagcaacacctgcgtcacatgcacatggagcgggtgatgttgcaacaagaattccggatagagtgtcgaaattgttcattcacgcacacccacaaacagatactggaggatttgtgggagcttggcgtctcgcgatacagtgaagtcagaatctccgcgcagtcgaaactgttcgccatgatacaatattttccctattcttacacgttgctgaaagacaaaattagggaagtcctgcagatgaattccatagagaaccacgagaggttcaaggggtgcttgtatatactcttgggccctaaggcggcgccgattatcgccagacacgactggaatttcataaaggacatctggcccctgatagtcaattcgatgccgtcggaaaaaccttccatagtcaacctgatcacgaacctaagtgattctgttcacaagttttttccgactatagccatcaaactgattattccggagaaagtccttagtgcggctcgtaatttcgccgccgtagaacccttcgtctgcgatctaagcgcgtttcaacggttcatcgatgacggcgaaatctacttaaagaatcggtcgttggaacggagacgagcctatgatactaccgttagctccttgttaactgcttgtgagactggaaatttgcattggagatacaatgccatggcgataagtttgataaagaacctcgtgcacttcgacgtgaagtacgacgtcaacgtggtcaagtttttcctgaaagccaccatccacgaatcgctgaatatcaggaagaacgccatgaaggtcctcgtttttatattggtacagaacaagccgaagttcgaaaagatcgaggtagatccttaccagttgtccaagtgcgagcggtcgggtcaaccgctggtgcccggtgaacgtggcgacaaccgctggttgatctaccacgaacagaacgtcccgaaaacggcggagaagtgggaggaaacggtgttcgtacacgaccaaaccaccggatattactcctggcccaaacacttgatggtctacgcgcccccatccaaacagaagaccgtgatgtctcgcaaagataacatgactgatatcgagcgcgagatatacgcgttcttcaagaacgaggcgaatatatccgagttaatccgatacttgtcgttggaagagaagaagggacaagatcagttcaacgtttatcggtttttcgccttcaagaatctcttcaagatgttcgaagacgaatttctaccgttattcctgccgcacatcagaagactggctaaggacaagcaggaatcgaatcagaggtgcgcggcggagatagcgagcgccatcatccgaggctcgaagcactggcccttcgagaaaatcaagaagatgtgggcggagatgttgcccatcatggagagcgcaatcgtgaacatggggaacgagacgctcatggactgggctctctgcatctctatgggaatagagtccagggatcccaacatggtccattggctgctggagttcttgatggacgacccgctcaaggaccccacgtctttcgtggcctgcagtcgcgtccacatgctgagcgtggcggtgggacaacagtcctggcgcaacatcgagatcttcaacaagatgctggactatttcaggccccatctgacgcaccctttccagaatatccgggagaagatcagcgcattcctctccctgatctacgggaaggacttggtgtttcccgacggcaatcttaccgacggtcctagaattgaagactttttcagagatgtgacgcctagactggatcttctgtatcactatactgttaagaagagcgacgccaatttaaagaatgacatagacgaaacctgtgataatttaagtttagtttctttgaattctgaaaatgaacgagaagaggttatgcgacttttcaaaacagtggcgaggtttatcactctcagcttggcaagagtaaacttctccgcgcggcccgaattcttcaggttattgcccttggcggcggtgctgagaaattacgagaaggacgaggagatcgccaacctagccatcaacctgttgacggtcctttctcagacgactaccatgaacgcgtacattccggatgccataacggccatcgcgaaggtggtgcggtgtcccctgtggtcggcgcgaagcatcatagctgaattcataccggtgttcgtgttctacaacatgcctactgtgaacaagaacccggagtgggttttgcagatacagcaattagtgttggaattgttggaggatactcagcccgaagtgcggctggaggcggctaaggttgttagtggattactgcattgtcagtttatcccgcaaccatctcaattattggatctgttcaaacaaaaggctcgaactaaggtgaggagattgaacaatagcggtcaaaatctcgtcatcagacacgccggagttttgggcctgtgctcgttcatcagcgctcatccttacgacgtgcccgaatatttaccgacagtgttcgcggccttgggcccacatttaagcgatccccaacctattcctgccactatcagaaaaactatgggggatttcaaaagaactcatcatgataactgggaaatgcataagctgaagttcacagaggaagaattatgtatattaagtgacctaacggtacccccgagctattatgtataggaatttgttcttatttaaattacactagtagaaacattattggacaaggtgaacacaaggatcacgcatatgatcacattcaaattgttgatttttgaaatattttaggtaaattgactcaaggtgtttgtattattgtttttaatttatttattaacttttaccttactgtaattaacgtactaggacattacaaagagagtgttggttttttaagtgcaaatataatatttttacaagaatttctttatatttctttaaaatgaaactccattaataaaaata

SEQ ID NO: 336 - DNA, 4158 bp, Rhynchophorus ferrugineus
tctttgaattatgttttaagtgtacatatgtctaaatataaacatgataatatattaacaaagcagctaacctataaaattgtatgtgtaatatacattggatagtttaaaagtacaacttctgtgattatttccttgatattagagcagttttcatcttaaatcatggctagtgtatcgtatcaaataggaaatcttttggaaaagatgcagtcctcagacaaggattttcgttttatggcaaccaatgatcttatgacagaattacaaaaggatagtattaaattagatgatgattctgaacgtaaggttgttagaatgttattaaaacttcttgaagataagaatggagaagttcaaaatttagctgttaaatgtttgggccctttagtcaacaaagttaaggaataccaagtagataccattgttgaggctctttgtgctaatatggtctcagagaaagaacaattaagggacatatctagtattggattaaaaacagttatagcagaacttcctcagtctcttggaggtatgtcaggtactatttgcaaaagaattacaggaagattaactacagctattgaaaggcaagaagatgtttctgttcaattagaagcattagatataatagcagatttgcttctgcgttttggcccactactaagttcttttcaccaatcaatattagcagctcttttgccacaattagaatctcagaggcaagcagttagaaaacgtaccattggcgctttaagtaacctggtattgtcatgtaacaatattttatatactaagctgattgatcatttaaatgatggtttgaatgcaaacagaattaattctcaaacgcgtacttacattcagtgtgtggctgcagtctgccgccaatctggtcacaaatttggtgaacatattgacaaatttgtacctattattttggagcgttgtaacatagatgatgaggaattaagagaattctgcctgcaggcttttgaaagttttgttaacagatgtccaaaagaaattactcctaatatccctaaaattactgaactttgcttaaaatatatgacatatgatccaaactacaactatgatgaagatgaaggatctgaaaatgttgaggctgaggaagaagatgatgatgaagaaaatgatgagtacagtgacgacgatgatatgagttggaaagttcgtaggtctgctgctaaatgcctggaagctataattactacgcgacatgagcttttaccagaattttacaaagtactgtcaccagctttaatatctcgtttcaaagagcgcgaggagaatgttaaatctgacattttccatgcttatattgctttactaaagcagacgaaatcaaccgttaatgtcaacattgatccgaacgctatggttatggatgatgaagaagaaagtcctatgagccttcttcaaggacaaatagctcttctggtaaaaggcattcaggcacaaatgaaggaaaaaagtatgaaaacaagacaagattgttttcaactccttaaggaagtttgcactgtacttccaggggcgttaagtgctcatattggtgacttaataccaggaatcttgtattctttgagcgagaaaaatgccagcagtaacatgaaaattgatgctttatcttttatttattgtcttttaactactcattcgccttctgtatttcatccttttatcgataccctattacagcctgttgtcactgcagttggcgacagtttctacaaaataacagctgaagcccttggtgttttgcaagaactagttaaagtcatcaggcccatgcaggattatactggctttgatttcacgccatttacgaaagatatttacgcatgtacattggtacgtttaaaagcatctgatatagatcaggaggtcaaagagaaggcaatttctactatgggacaagttatttgtaatttaggcgatcaactgataggagaattgccgttttgtttgccattatttttggacaggcttaaaaatgaaataactcgcctaacaacagtcaaagctttaaggaaaattgcgggatccccgcttggcattgatttacccatcttacctgaagcaatgcctattttaggcctgttcctgaggaaaaaccaaagagctctaaaactgagtacccttcaattaattgactgcctcattcaaaattatcacaagaagttgaatgtacatttactacaacccattattgctgaaatacctccattattggacgaatctgatttacatattgcacagtggactttgattattctaaaatcaattgctgttgaacatcctaaagctttgctggacataaatagcggtataatgcctcaagttctaattctggtcaaaagtcctttgctacaaggaactgctttacaagcaatgcttgatttctttaaatctctagtcaaatgcaacctaccgggtttgtcatatgatagtttgttaagactgttacttacacctataacaaatttatctgttaatcagtcagcaaccttacataaacaagcattttattctcttgccaagtgtgtagcagctactactgttgtatgtcaatctcatgcccttccagtggtaccacaatttatcagtgaaatccaaaacgccaattctgattccaaacagatatttgctcttttggttgtaggagaaattggaagagaaattgacttaacgtcagtgcctgatttaaaacaagttattttgaatgcattttcagctgtttctgaagaagtaaaatcagctgcaagttatgctttaggtagtatctgcattggtaaccttcagcaatacttgccatttattctaaaagaaagtcaagatcaaccgaagagacagtacttacttttgcattctgttaaggaggtcattacatgtctttcacaaaacaatgaaggtatccaacagctacttccttttgttcctgatatatgggaccaactgtactgccactgtgaatgccaggaagagggtacaagaaatgttgttgctgagtgtcttggaaaattaacattgatagaccccgctaaattgcttcccaagttgaaacgatctctaaactcgccatcaccattaatgcgaacaactgttgtaacagcagtcaaatttactatatctgatcagccatcgcctattgatcaattattaagacaatgtattggagagttcttgaaaactttacaagacccagacctaaatgttcgaagagtagctttagtagcttttaactctgctgctcataataaaccatcattgatcagagatcttcttgaaactatattaccacaactttataatgaaactaatattaaaagggagttaatacgtgaggtggaaatgggtccattcaaacatactgttgatgatggtttagatataagaaaagcagcttttgagtgtatgtacacactcttagattcatgcttagataaaatagacatatttgacttcataaaccacgttgagtctggattaaaagatcactatgacatcaaaatgcttacttacttgatggtggcgagattagctcaaatatgcccgggatttgtattacaacgattggatagactgatagaacctttgagagctactttaacacagaaagttaaagctaattctgttaaacaagaatatgagaagcaagatgaacttaaacgatctgccatgcgtgctgtagcagctcttttaagtattccagatgctgataaaaatccccacttaaacgacttcgtgaatcaaatcaaaaactcatcagatttacaaccaatattcgagtcgattcaaaaggattcttcatctgcacacgcggactttttgatggatcagagttgagccatagttcatatttctgcagcatcaatgtgaaggttttagttttatttttgcgtttagaatgtttaatgataatttattacgtctttgagtcttaaacttttcataaatcattttattaatttaaattttagtcacacagttgcatgccgatagattatcagttttgagcagttaattaaaaaatcctaattttatcctgttaatttgttaaaaatatatgttgaacaaatatttgattatcatatttttattgatacttgaaaacaatgtgtttcataaatt

SEQ ID NO: 337 - DNA, 6347 bp, Rhynchophorus ferrugineus
gttcccaacgctaagaaaagccctgaaaataatcagctgtttaatgtcataattttttgtcaagctatctagatgtcttccttcccaaatataaacacattaataaacatggcgtctacgcagagggcgtttacacaaaaattgtcaaaacaacatgcagccgatttgcgtaaaactatttccagcaatagaactggattgatcttgccatctcctagtagtaattggatacatgaaatatctgaccctttagattttgaggagtatgtaaacgcttatcaacttgctattgatcgagaccctttaagaagcatactagacattccattaggagatgtacaggttgaagttattgaaagaccactcagaaccttaaggccaattcttccggaagagaaaattgatagcttaccacctcatgtgcagacctgtgtgggttgctataaatcagtgtggaaagttgttcattacactcagaggcaccttagcagcagtactacaagtagagctaatttatctaagacaattcagccaagcccaaaacaagaatttgaagtagattttcaaccatcatctgaagctaatagtgatattgatttagcttcacaaggtagtagtagacaaagtgtagtatctatcacctctctttcatcgtgtggtgatactttaacacctagaaattcttgggcatctttagatttaagacattcagctggtgatccattaatacaagaaattctagatcagtcagtgttggaatctcaagatcaagttaatgaaagccaaagacaaattgaacgccaagaggccttatttgcgttgacaccaagtgatgtccaaaatgagattagtgatctggtagaaagaaggttgccagcaaacgctccttatgaacatattggtcatagagttttagtaaaatgtcaacaactaacattggatttggaagttgaaccattatttgtttcaatggcactctatgactctaaagaaagaaaaaaagtatctgaaactttttattttgatctcaatccagaaggacttaaaagaatgttaggcagccatattccttatgcagatgctagcacattatcacgaagttgcatttttaatattactaatccttctccagacttattcattgtagtgaagttggaaaaagtattacagggtgatattaatgattgtttggaaccatacctaaaagaagaaaagaataaggataaattaaaatcagtggctgtgtcattttgtgaaagattaggaaaatatcgacaagcttttgcttggactgctctaaatttgtttaatgttattaatgatggaaattcggtagacagagatctggataaggaatctacaggatcaggatccaatacaaatagtttagatcgaaaatcatctaatagtggtttggatcagttacgtcgaaaagctgctgatatgggtactctgaccaggaggggttctttagaaagaaaagataaatgccggtcatggtctccagatcacttagcgacaaatttagacacatttaagcctattaccttaaagatgacctcatttttcagacaagagggggataaaatgagagatgatgacttttacaaatgtttgcaagagctaaaaagacctacattagttttaaaaaaattgaaatgtatttctaccaccttcaggttggaaatatctccctgtccgttggaactgaagaactgtctaacaactgaactggaaaaacttcatccatatcctgacgagaaatgtcgaccgacaaaagaacttttggaatttcccgttaaagagatattaacgcctcattatgtatatcgaaaccttttatttgtcaatctgaaagaattgaacttttctaatagagcaggttctgcaagaaatttagccgtaaaagttcaacttatggcaggggaaaacgaaaatcatgcattggcaaatattttcggaaaatctagttgcccagaaatgactaacgaggttttctccgctgttacttatcattgcaaaactcctatattttatgatgagattaaaattaagctaccagcttcgttggctgataatcatcatttattgttcacattctatcatatttcctgtcagaaaaaaactgaacagaatatagttgaaactcctgttggttatacatggctacctcttctttgtgatggacgtttagtttccggtgaattttgtttacctgtaatgttggagcctctgccaaaaaattatagttacattcctccagaagtttgtttgccagacgtgaaatggttggataaccataaaaaccttttttcagtgagtctcgacacagtgtcatcaatacatactcacgatcctccaattgaaagatttttttccgcttatgattatattcatactggaattagttcaaccaggcatggagaaattgggtctgaaaaagaatttatcactataatattgggcctatcgggtgctagaccagaaacaattgtgaaacatttacctcagatatttgacagtataattgaactattagtccaaccacctcgaatatctggacatacattgaatattggatcaacatgctttgaaacactatgcatgcttttagaaaacatatcgaatattcaggaacttcaagtagatcatcacggacgcaatgctctgttagctacttacatacattttcagtgcaatttaccacatccgttgtctcaaggaaatcaaggctctttacattgggaagggggccctttaattagaagcaactccaatcctgatttagaagtatcccactatcaacctagaggtttagatcgggcatcaagcatgcgtgtgccttctaacgaaccgatcagtcccacattcactacttgtcccagaattgtgcatcaagaattagcttatcagtggacaatcaccagcggaagaaataaagatttagccatgcaaaatgcttggtttttatttgaacttatcaataaaagtatggtggaacatttggcgcacagtaaaactttagatgcccctagaaaaatacgttttcccgaacaatttatggatgaaatttcaacgttagtccagtacgttactggagaaatcattttatattcacgcggtgaaactcgtaaagcacataaattaaatgcggctcttgctttcttccttttcgatttgttgtcgatcgctgataggggatgggtgtttcagctgctaagaacatacaacaaagaagtgcaacaaaaaatatcgtcgttagtggatggcagtattttgatagaattgaaattggaatttgagcggataatttgcagtcatgagcactacgtcgctttgaatttacctttttcaacaccatttatgtgctcctcagcgggggtatcacctagcccgagtgttacaagttcaacaagtcagaattcgttcttatcaggagcaccgccaagccaggaacgagtcaatacttttgctgaattgtcaccggaatatcgccagcatcattatctttgtgggttggttttaaccgatttggccgcagttttgttagaggctcatcaagcatcgcttcacagtaaagcagtagaaactgtaaaatgtctattggcttgtcatgatggagatccacgatatatatcttccgaagcaagacaccgtgtagcggcattatattttcctcttttgtccatcaccatggatgtattacatcttttgcatcgtttttcctttgataaaaatgataaatttagtaacgaagatacttgtcccagtaatattaaccccaatgttgctttagttatcgctgggaaactaccaccctctacttgtgattcatttcaacctctccaaaatcggaaactaggaattagtgctgaaactacacgaaatttgttaacttgcgtactgtgggtgctgaaaaatgtcgaacgggaatctttatcgcaatggatgggagaactaacttcaacacggttagcaacattactacagttactggacgcgtgcattacttgtttcgaatataaacccagaagaaaagcatcaccttcatcaggatatgctcatgctcaagtaacactagatattcgctctcgtttggaggatgttatactaggacaaggatcagctagggaaatgatgcaacgcaggaaaggtaaaaaggtggaacccctcaggcagcatctgaaaaactgcgatggcgtaaagaacaaatgacttacagagtaagcaccgaactaactgaaaaaccaaaagatgatattttcaacgacagtcatttagaaggtcattttgcaactgaggcgtcttttatcatattagacactttagaaagatgcgttaatacgatagccctctttgattcaccgcagcatttagctggtttagccttgactgtattattgcatgccctagggaagaaccaaagcaccacaatattaccgcatatgtttgcgtcccaacgtagccttgtttataaattccacagtgctttatttgacgaagaaagcagtcattgtgcagatttgtgtttgctgctattgaaacattgtggttctcaaataacatcggttagatcacaagcagcagcttcactttatttattaatgagacaaacgtttcaaattggtaataattttgctagagtaaagatgcaagtaacgatgtctttaagcagtttagttggaacatctgctacattcagtgatgattccttacgtagatctcttaaaacaattttggaatatggcgagagggacacagaattgcaggaaacaacgtttcctgaacaagtcagagatctggtattcaacctgcacatgatcttatcggacactgttaaaatgaaggaatttaaggaagatcctgaaatgcttttagatttaatgtatcgtatcgcgaagggttatcaaaattcacctgatttaaggttgacatggctggctaatatggcccaaaaacatatggaaagaggaaaccacaccgaagctggaatgtgtttagttcattcagcagctttagtcgctgaatatttagcaatgctagaatcattgccgcatttaccagctggcgcagcagctttagaaaaagtaagcccaaatgtattggaagaaagtgcagtgtccgatgacgttctcagtccagaaagagaaggcggttgtctaggttcccactttactgaagcaggacttttgggattgttagagcatgcagctagcagttttcaagtagctactatgtatgaacctatgaacgacatatatagggtcttaattcccattgctgaaaacaatagggattttaagaaactagcaaatatacacggtaaacttcatgacgcatatactcgtatagatcaactacaaggcaaaaggatgtttggtacatatttcagagttggtttttacggttctaagttcggtgatttagataaagaagagtttatctataaagaacccagtttaactaaactgcctgaaatattcagcagattggagaatttctacgctgaacgtttcgaagcccataacgttataattatcaaggattcaaatgccgttgatgttaacctactcgatccagataaagcttacatccagataacatatgttgaaccatattttgaacagtttgagctaagatatagacaaactcattttgatcgaaacttcaacataaagagatttgtttatgccaccccatttacgatgaccggtaaagcacatggcgaactgaaggaacaatataagagaaaaactattttaacaacagcagtacatttcccttatgttaaaacaaggatacaagtagtatcacgaacgcaaatcactttaacaccaattgaggttgcaatagaagacattcaaaaaaagactgcagaattggccacagccactcaacaagaaccaccagatccgaaaatactacagatggtcttacagggttgcattggaacaactgtaaatcaaggcccattagaaatggcaataacatttttgcccagcgatggaaaattgctgactaagcaccaaaataaacttcgattatgtttcaaagacttctccaaaaagtgcagcgatgcactgaagaaaaataaaaatttaataggtccagaccaaagagactatcaaagagaattagataggaattataaacgttttattgagaaattacaacctttagtaaacccttcttccattactataattaacactagtccaaataaatatgcacacactgagaactctgtgttgaaatggtaacaatatcactattaacatcatatattttagaatacacgctatttatttactatttatagaattttatataaaatgcctttaccccac

SEQ ID NO: 338 - DNA, 1580 bp, Rhynchophorus ferrugineus
cggcaaacaagccggaggccggcttcgcggctccctgattggccgccggtcccctgcgaggcgttcgaaccaaagttataaaagagcgtcgagcggaacggaccctgatgggcgatcgtgttggggacgtggggtcgtgacgcgctaacagaccacagacgagcggctcagcagagacgacaacagcgatttcatccacgatatccggcgtcgcgactatgtgctggtgaatatggtggtgttggacaagtggaaaaacgagtgcgtgatgtcgaatacaccgctgaaatcgttcaccatcaattctatattaccggagactttgctcgacagaagaagcgtcacttccgaggacgaagaggacgcggaacgccaggaggaactgtcggaaacggaggtcgctgatgtgagtgattgtgattcggacttggacgtaaccggtacgggaacaccaccattggattgttccagtcaatctaacgaagaaaaaaatgagaacggcgaagacaaagagaaaaaaactaacgataaaccaccgtacagttacaacgctttaattatgatggctattagaaatagtccggaaaaacgattgacactgaatggtatttacgaatacatcatgaggaattttccatattatcgggaaaacaagcagggatggcagaattccatcagacataatctcagcttgaataaatgtttcgtgaaggtgcctcgacattatgacgatcctggtaaaggcaactactggatgttagatccttccgcggatgatgtcttcatcgggggttccacgggaaaactacgacgaaggtccacggcggcctccaggagtcggttggcggccttcaagaggacgttgtccatgtatccaccgattcccggttgttactccccgttttatccaacctctccagctctgctagctgcgtactctcgttataatccatatcttcacggtgcactacctcgaccgaatttcccgggtcaaccaccctactccatggataaatccatgagtgcttccgctccagaactgtcgaacatgtcgccgatattccgtccttcactactacagatgtacaacaacctgcgattggcatctccgttggaatatcctctccaactacctttagtcaacctggcatatcaaagaatgcagagtctatcgctacccggggcttcgccaccggaatcaggaccacctcaaccgtccaccgggcccccaccaccaccggaaggtctactgaaacccgtgacagtgataaccagaaacaattgagcatactttgttgtgttttgtacatagatatacatatatggaacgcttggtgtattgttcttaaaccaaacacgagaaatccgacggtattctctagtgaaattgtatgtagcacaaaaacgattatttatttctgtttatttgtatatagttagggtattgtacataatccacgtagaactgagacataaacgaaatgaaaacaacgcctcttgcttcaaaactaatagtaccttgttgtcggtcctgtgatgtatatatacatatgctaattagattagtatgtaattgatct

SEQ ID NO: 339 - DNA, 1286 bp, Rhynchophorus ferrugineus
gttgttatttgatgagtgcgtagagtgttagatctcagcttgagcaccgcctgtaactattgtgactttgtgtttacttgaaatttgtaactctcgtgaaagtgcgtttgtacgatggttctgaataaagaagtatcacctgcacgagaaatgttagccatgggacacggacacaaaccgacggtgaccaatttctcgatagtcgccctgttgtcgtcgaagaatggatcgggacgtccgcaatcacacatggatgctgtagttgagcccgaatgttcgtccgacgatgagcttgatgtgaccggtgacggcgatgacgcacctttggactgcagtaaaagtagtgagtctgaaaacacggaacaaactaaattcgaaggaaagcctccattcagttacaacgccttgataatgatgtccattcgcgacagtcccgaaaaacgtctgactttgaacggaatatacgagtatatcatgacgaatttcccatactatcgcgaaaacaagcagggctggcagaactcgatcaggcataacctcagcctcaacaaatgttttgtgaaagtcgcccgcagttatgatgaccccgggaaggggaactactggatgttggatccatcggccgaagacgtcttcattggcggtaccaccggaaaattgcggaggagatcgacggccgcctctcgctctcgcttagccgccttcaggagaagtttctacatgtacaactccctgcctgtctatcctcccgtttatccgggtacgacgcctcccccgtcgttctggccctacctgcaaaccgccacgccaacattaccggtcgtacggccgtctccaatccagccccaacccataaccatcgaacggttaatgtcatcgcagccacgtcttaatttctatcaacgccccgtcgactacagccatatgatgctccccgaacatctcatgatgccccaacagcagtaccaaagcccccatcaagtcccctcgccagttagcagcacctccagtatatcggaaccgagaacgagtccagtgcttctacctcggatgagttaaaatcgcctctcaaccgaaaaaaaaacatgtgataactgtctcaaattatgtgtaactttgtaaataattcttgtacatattcgttaaaataagacagaagccaaaaagttagatttaatcgatcgtaaattaaataaatgttcgtcttagacatagaacgtagattatagaacaactttattgtgatataattataagcagcacgaaataaattattttaatttatc

SEQ ID NO: 340 - DNA, 601 bp, Rhynchophorus ferrugineus
cttttcgtttgaaaaagtgtgtggttcaaatattttcttcaatatatgttttctaagtgtatttatggtgtcgattgataaattgaacattagtaaatatgactacgtcacctccaaagttatttacacctagaaagcgaccagggataaattgtcagacacctagtcaatattcaacaccaaaaaattttaaaaagtttcaagcctctacggagactccggagtgttttaataatgttttattagagaccccgaaagcccggtctaaagtcagtaaggagaaatgtgatgaaattgcaaatttaagagttgctataagaattagaccaatgaattcatcagaactagcaactacaggagttgaagatgtggtcagaattaaaaataatgaacttataatttgcgctcctaaaaatggtcatggagttttgactgatcatatttttcaatatgatcatatattttggtcagtagatgaaaaagacactctttacacttcacaagaggatgtatttttaacaataggtgtaccactcttaaatagtgcatttcgtggaattaatgcttgtttatttgcatatggacaaactggatctggaaa

SEQ ID NO: 341 - DNA, 3969 bp, Rhynchophorus ferrugineus
  misc_feature (3614)..(3619): n is a, c, g, t or u
tagacctggccaaagagacatcggacaagtgcgtaagtatgccttcgtttgaagagattaccggttatgtacattgtgaggccgagataaatatggaagataagaagaaacacgttgtttatgggaatcatacgttacctttcgatgtcaatacgtacaaggagattttactgtatctccgcttatgcctgattagggatctggacgtacctcttacgcgagaagtgttgaaacacccttgcgagtattcaccgacaatttcaaagcatctccgcgaactgttcgagaaatgcgttaagaaaaataacgttttggtgcaatacgggtccttaattaggaggttactgctagcacatccagcaattgaaccgttaagctgcatgacggagttgattgcttcagtgccggaactcaagagtttggtcgcaaaggatgtgcagtggttgagagaccaactgaacaacactaaagaggaagtcagggaatataatgccgtgttatattcattggttttggttgaaacggtagatgacgctgctttcattgaagcaataaaatatttgattggccagacaacaaacaaaagcttggaagctcaacacggagctctgctggcaatcggaaattgtatagagtattttatattaaagaaaaagtgggagaataccttaatggaaaataacgagctaatcaggagtgccatcgaaacactcgcatcttttttgaaacattcgaaccagcttctggcgggagctgcctgtactagtttgggtggtattggaagaatacagggattaccattagacaatggtaaatctaccccctcgacggatagccctgatgcgaaaagaccggctatatcaagcattaccaagctacaattagttgaaaaactacttgatatcatgaataatgtgaaattatcagcaaaagccagggagaaagctgcgagatccttgggtctgatatgtgtcggtgaaagattcgtacataccaagaaagtcctccagggattgctacacaccgctaaggagaccaaagatgtagaggttcacttcactattggcgagtccctggtaatgggctgtcaaagcgtttggtcagcagaggcccgcaactcgtggaaagtcctacccaaggattacgcgcccagtaccacagagcgtttggaagacgatcatctggactggttactggaggagttgttgcggctggcttcacaaactcacccaaactcaaaacaggcttcgtgcatttggctattagcagttattaaagggtgtggagaacgggaacctattaaaaaacgcttgcaggaattgcagaacacttttatgggcttcctgagtgaaaacaatgacatagtccaagacgtcgcttccaaaggtctgtgtgttgtttatgatacatataaatccgaagaactgctcgctgctttggtaaagcaacttacgtcaggatccagaggcgtaggtcaaatatccagcgataccaagttattcgaggagggacaactggggaaggctcctacagggggaaacctgaccacttataaggagctgtgttccctggcctccgatttaaataagcccgacttgatttaccagttcatgcatttggcgaaccacaacgccatctggaactccaagaaaggagccgctttcggtttttcgaccatagctgagaaatgcggagaagatctgaagaatttcttaccagatatcataccgaagctttacaggtaccagtatgatccaactcccagcattcaaatgtccatggccaatatatggagggtactggtatcagaaccacaaaaaatgctcgaccagtactataacgaaattctgcgggatctattggacaatatcaattcatctcaatatagagtcagacaatcctgttgcttggcgttgatgccatggatgagctgtggggaaaactattcagagtgatggacgaccatcacgaacagacaagattgaccgccaccagaacaacgcgaattctcagcaagctgtgtatcagaggatgtgatattagtcagggaaaagccggagtaaaaatggtagaagctatccttcctccactattaaataccggaataactcatactgttgctgaaatacgtctcatcagtttgcaaactgtctcagaattagtttcctcggcagggaaacagctgaaaccattcttgcccaagctgattcccgcgttgcttcaggccaccagcgaactggagtccgccaaattgtcttatcttagtacgatgatgggagggcagtctcaggcgcaggaagcaatcgatagcgctagggcgtccatcgccaagtcgcatttcaccacggaaacggtgtcgaaaagcttgcaatatgccgacgctaccattctggaggagctggttcctaaaatcgtggaactgatgaagggttcggtcggtctgggtactaggattgcgtgcgcgcactttatcacgttgcttgtggtgcagttagggaaagacattcaaccctactcaggcaagttcttggccacgttagttaacggactgaccgaccgcaattccgcgataagaaaacattacgccaccgccatcggccatttggtctctacttccaaagaatccagcttagacaagctctttgacaaactgaaactgtggtatttcgaaagggaagacgattccatcagatcagcttgtgcccacactattcagtccataggcgttcataaccaagagattttaaaatcccattcggaagtggtgctgccgttagttttcttcgcaatgcacgcggataaaacgccagaaactcaaaatactctggacgtctggacggaggtttggtcggaacacagtcccggcactgaaactggaattagacaaaatattgagaatatctgtgcaatgttaaaggaagctctggaatcaccgtcgtggacgtgcaaagctcaggccgctaatgctatagctacagtcgctagcaaactgggaactactatggatagcaagtaccgaaatgtactattaaatattttgctgagtggattaagtggtaggacgtggaatgggaaagacaaactgctgaaagctttgagtagcatttgtactaattgcaaagacgcagtcaaacaagacccggaagtaaacccaaagagtataatagacgccgtactgaaggaatctaagaaggaagagatcagttacaagatcagttcatggcagtgtttgggagaggttgtgtctgccttggaaatggatacgttcgaggaagtttacaatattattgagtcgacattaagaggtagtgggggaagcaacgaagacgacgaggagggcatgtccgcgcaggaggccaagaagggtcgggagaacgccattaagctcaaggaggaggcttacgagaccttggggaaggcgtggccaggcaatagcgacgccacccagaagaaatatcgggagttggtcgtggatcatatactggagactttaccggtggtgaccagatcggtgcaggtcagcgttctctcggcgttgtataacttcgtcgataaactcctcctcctgaagcagaattccttggacgaagccgacaaacgggacttgggaaagnnnnnncgcacactcgactgagaaaggaggccttgaacgtgatcttctgtctggggacgcggcttaaagcttgcccggacgcgaaagaacaggaactggaggtcggcagggcgttcgcgctcgcacttcccgatttactcagcgacactcaaccggagatcaagagcagggtgaacgatatcaagaagatgtttagttaaggatgcgactcggattaattgctcgattaattttgtaataattggatttcattaaaaactgaccattataattctatttttttgattctgttgtgtggattggggtaaaaactactattgaagatggaaagagtagctgttaaagtagtattggcc

SEQ ID NO: 342 - DNA, 1469 bp, Rhynchophorus ferrugineus
caagaaaacaacagctgagtgtcaatattttcttttatattccaaaatagtttagtcatggcaggagctgtggatgaattaatgctcctggaaagggtttttcttagattaggttctgcagaaactgacgaacaattgcaaaatgttttatgcaagtttctaccgccagttttacttaagttgtcatcacaacaagaaggggttcgtaaaaaggtaatggagttgctaatacatgtaaatagacgaattaaaactagaccattagtacagttacctatagaagctttattaacacagtatcaagatccagaagctacttcttttgttactaatttcactattatttatataaaatctggatttccacggctagaaattgaaaaacaagctgaactagtacccatggtattaaatgctctacaaaataaaccagtcactcatatggacagtttgttattgttgctaataccattgctaggaaaagttaaggttcctacagagcctgaaaaggttgctacattatttgggttaaatgaaaaacctcaaatttctaaacatttgttagaattattgttagatatgcttctgttaccttatagtgcattgtcaccacagtccccttctggggaagctcagtcaagcaatgtttcacttccagttcctcctggtatgagtgaaatgacatataagcgtataactaataacaatcctatgaagccagaggaactggaagaaattaagctgggtatagtaaagttcttagctcatggtgttttcaaaaatgaagacatcctacctcatttcataatagcagctgcagatactagatttgccgttgcaaacttagcagatatggaattgaagaaagtcatagggtcagtagattggggatcgtgtcaaatctctcaaccattatttacattgtttttgggtaccaaagtacccaaacaagacttgaaaaaggtacctgccagtacaaggctcagattaaaactgcttacttatttgtgtagagtgacagatgcaggtttcctctttcctgccagtattcaggtcatattcgacagtttatatggggagaacaccaataccagattgaaaacattagctctgaatttcactaataatttgatcagatatgcgactggtgataccataagtaaggtggctccagttttattggctggtctcattaaacagatcaaagagggcgaggacgtgcacaaaggtcaggcctacgttacgataggtatgctagctcagaaatttccccagactgtattcgaagatgtgggattactggagctgtactttaaacacctggaagtcgctaatccggatatgaaaatacaagtgagggagggtctgttaaacctaatactagcgtacaaacacgacatattccccagcgaggcgaataaggatggaaggttgcagctcctgttcgccttgatcaagataaatatgag

SEQ ID NO: 343 - DNA, 4009 bp, Rhynchophorus ferrugineus
catagcggtcgcctcgtttatttagttcataacgttcgaggtcgatcaaacgtagaagaatgataccctaacctctaaaaatagtaattaaaaaaacattaactgacgtttttcttgaagttgaatggtttttatagataatcagcaatcatggtaattaaaagtactaatcctaaaatcgaatttgtgccgcctgaaacgaaacttcacgcatttttcgatgttatatcggagaaaaagattattttccaagtaataaagatgcagagcagcgttatgatattcgtcaacaatcaagatgtcatgaactgcgataatatagttatggcgatgaagacaagattcagcgatactccgtgcagtaccacattaatgggtaacttaactgaacttgtgggaaataatattgccagccggctttccaagaaattagagaaacctgtttatttgagtttcaatttggatgatgataaagtcttagtgccgctagtggaggaacgattatttcaggagatccaacaaagtcccgaatgcttttaatgtaattaatatactgctttagaaaaaaaaaaactctcaaggtaatattttacacacatttattgttcaatatctaataaaaaattagtatgtcattttgctttatatacatataatagagcttaaaactttatatagtgaaaacagaaaaaaaacaattctcctttcaaaaaactttaacccaatcaattaatattaaatttatgaaactatactatcgaataaaattgccaaattatatatatatatgtattatttgtttcacttttttttcctttttccatatcataaaaaaatatttacaatttgaaaatggcagttaaatgagctatccctctaagaaaaatgcgaatgaaattactttgggtgacttgcaactgtttaaaagacactcctacagacactagatcttatcccatttagatagtaatctaccaaacatacctctatgaggaacagtactgtctggtgtgtaaggtattgaataaaatgaaaagttctaagaaaactcacaagactaatcaaaattaccactcttaatattcatagatctatctttccagtgaggtatatagtaattatgatcctagtcttgcaagattatttttgtcacaattcacagcttctggaaacaccccagacattatctgaagagtatccacaatgtaatattttatttcaggtgagatccctcttgaaaaggttcaatgtgaaatactatattctggatacactttattaaataaataccatgttaaacaagattttttattatatatttgtgtcagatattcaatatatttatatagattagataactcctgcccagacaaaaataacactaacataaatcaacaaattaaaatacatacactgctgttcaaaaatttgcatcttgtgctgcggcttcttcaggtcaagtcaaagtacgtcgagagcgaaaacgtttacggtttgatcaggaatgtatttcaaatttctgaacagtcgtgcagatatcacctcattatagttggacagcagtgtaattttgtacgaaacaaccgagaagcaaccgtttcatgtaggtgaagaaacgcgctgacttggcggacgatttcagagctgacgcagttgtctcgtcatggtctcgacgcgagaagaaggctctgcacgaagcgcctcttagttacttccgtggggaaaaacgtggattggtcggcgaatggatgaagctgcgcagctcgtagctcatgtcgatgccgtgggcggtggccgtgtccatgtccgactttttggatacgatcattcgaatgtcgctgtggaggtatatcttattcgattttgagctcataaaccgtaaatgtatcacatatcgaagccacttggagccccattctgaaccgttcccctgacaagatgtgggcatgtacaaggtgcgttgcctgataaaagtctgagagttgggcggcatgtcggacaagtcatacatgatgacgaacatcttcaccaccgtgcccagcggattgaacaacgtcacctgcacggtcccggacttggggacgttgtatcccttcttgcccaggttgatgtgacccaagtatggggacgatacttgatcgttgtcgccgaaactatagaaaaacacggtaaccggtaagaacacatgtttgggaacgaacgatccgctggctcctagttctgcggtgaaaccgtgtaccgtggataccggttccaagcgaccgttcaacactgactcctcaaaactacctaacaaactggacgactgtcccttgcgtttatagacggcggcgcattggttcttcttggcggcgatgtagatttcggggctgcagggcgacacgatgctaccttcgctttcgctctcgtcgtccgttgagaagctgttagagaacagggcactttttatcgcagagacggaatttaaagtggaatcgaaatcgaaactggtctggcctttgcgcaccggtgccggactgctcgtcaacggcaggcccgtcctcgagtggaacaccatcgacgccgcgtttcccagattcctcctgaacttggcctgttccgtcgcgctcggtatgtcgcaggcctgagatccgcccaccttgttcccctcggcgtcgtcctccccctcgaaactgatcctcttccgagcgccggtcttcgacaccggcacttcgttatcacaatgtttatttacaggtacattaatgctactaatcttctccttaacgctaaagatatcacgttcattcatatcacaatgggaatggtcatgacgaccgctgcgttcgatcgcatccagcaacaactggcccttgtctgtcggccacttgagatccagcatggctctgtcctctgacggttccccctgctccttcttgtgcaactggcatatccgcttgttgttcgcgcaggtacccggctcgtggccgttattctcgccttcctccacgtcgtcgcatcgatgcttccccttcaacgtacacctgctgtacatccggtcgtccaccaggctcgacgagttctcctccatgaccgtcgtcgccttcgtattcctgcactgcgcgcaactgatgtcgggcacggcagggctcctgggggcgctgaaaaagaacgcgttcagcgacctgccgtctccgaggtccgccacgggaaagtcatgtcgggaggcggtcagaccgaactttggcggcgcttccaggtggtccggcgtggtcagacggtaacgtagattgtccccggttatgcgaggttccgtttggtcctgggtgactagccaggcggtcagctgagagaaatacaactgagaacggacggcgctgaccaattggtggaaattgaaaggtatattagggatatcttttttatcgttaatgctaaaattccactgttccaaaagaaaaatgtcgtcaaaatcggatacttctattccccccgttttattacagggacaagtcaggaatacttcgacgcagagtggtacagaagttttggtcaatttcgaaactgtctccttcgtagctttgtacttctgacacaaaagcgatttacgattgcactgatgaatcacttgacccttcttggggaaaggacagtgggggccctcgtggaagtgtttcgatttgggaacgtcttcgtcggatggtccggggattcgtccctccgttaccagcgtggcaacagcggacaatacctcgacgtcatttggaatgatactgatttcttgatttaacgtggcgctatgcatcctgtatcagcccttctgccatctcacactgtccgagcgtatataaacattcaattgtctcgtggaaactcaccaacaaactcgcacatatgctatataacagcacaattttctgtttttttcaactttttcgtatacatcatgaaataaattggatggtacttgtgggttgttttagtgaacaaagcaccaggactcaatgacagaaccacacgaccaggaggg

SEQ ID NO: 344 - DNA, 14564 bp, Rhynchophorus ferrugineus
ggagtcttgacacaggctgtcattaatggcaactggttgttgatggaggacattgatctcgtcagtgtggacattgcctcagtgttagcgtcgttactagaaaacaacgctctttcagttccgggatatcgggatttggtgccagttaagccaggatttcagttgattgtaactcagagactgatgcctactatgaccggccatcataaaaaatctctgactcttttagataagcagcttttacaggtgttcattgatcccttgactaacgatgaattgaaggagattttgcacgttcaatatccgttatttgatacagtcgccgatagattgataagcgttttcaatcttttctcttcggatacttataatgcgtcgtcagcaatacggaaaagcggtcgtctgatatcaacgagagatttttttaaatggtgctccagggctgctatagattacgatgttaagagtcaggctagcgctttaaaaattcttcaggatgctatagacgtattttgctgttcctttttggacaccagcgtttctttaaacttggccaaggaaatcagtgctcatttaggtattgttgaacagaaggcggaatatttcttcacagcgtacaagcccccgatgcaactgacatcggacagtttaacggccggtcgggtatcgcttaaccgaagccacacagtgtttcacaagcaagctaagttttgtttcaccagacccgcggccgtacttctagaacggataatgtgttgcgtgaaactgggagaacccgttctattagttggcgaaacgggcaccggcaagacctcttccgttcaatatttggctcactgtttgggtaaaaagctggtggtcatcaacatgaaccagcagtccgattcggccgatctcctcggcggttttaagccggtcgatctgaaactgctcgtcgctccggttaagaacgagtttgagacgttgtttcacgaattctacgtcgtgggtccgaaccaaaagtacctaggtaagatcgcgttcgcttacaacaccaacaaattctcggagctggtgaggttgctgaaagtgagcacgcaggcggccataaatcgactcaggaacaagatacgagaaaacgggacggccgatcagaatccgaaggatcaacagttcctcgtcaggtgggagcaggtgaatgagaaactgaagaaaatcgaagttcaagtgaagcagccaaatgcgttgtccttcgcatttatcgagggaagtttggtgaaggccgttcaggatggctcgtgggttttgctggatgaaattaatctagcaaacgcggaaactttggagtgtctttcaggactgttggagagcaatcaaggttcactgtgtctgatggagaggggcgacaaacaccctatcaagcgacatagcgattttaccctgttcgcttgtatgaatcccgcaaccaacgttggtaagaaagacttacccttcggactacggaatcgttttaccgaattttatgtggacgagttggccgacaagtcggatttgttgctcttggtcaataactatttggattctttatcactgaagcagaatgaagtatgcaaaatcgtcgatttttatctgaacatacggaaagagatgaaccaatcgctttgcgatggccagggtcacaaaccacacttttccctgagatctttgtgcagggctttgatgatagcttccaagaacccttgtgggaatttcaaacgcagtttatacgaatcgttttgtcttagtttcctgactcagttggattcagcgtcgtacaaagccgtcgagtcaatgattgccaaatatttaatcggcaatgctaaagagctgaacgctattctcaagcaacctattccggaacctaacgataaaggtagcaagtatcttcagtttgagggttattggattaagaaaggcagtttggaggccagtgttcctgatgaatatatactgacggaatcagttcggaagaatttaaaggatttatctaggattgtatctattggtaaactaccagttcttctacagggcgatacctctgtgggtaaaacgagtttgattatgtacctagccaaatccagcggtaacacgtgcgtaaggatcaacaatcatgaacacacggatttacaggaatatattggatcatatgtagcgagtgccagtggcaagttggtgttcagagaaggcgttcttgtcgaagccatgaggaagggccactggatcattctggacgaattgaacttagctcccactgatgttttggaggctttaaatcgagtgttggacgacaatagggaattatttatacccgagactcaggagattgttaaagctcatgctaacttcatgctgttcgccactcagaatcctccaggtacctacggaggcaggaaaacgttatctcgtgcgttccggaatcgtttcgtcgagttacacttcaatgaaatccctcctcctgagctggagtttatcctgcataaacggtgtgccatgccacccagttatgccaagagaatggtcaatgtgatgaaggatttacagatgagacgaaggggctcagcggcattcgcgggtaaacaaggcttcatcactttaagagacctcttccgttggggagagagatacagattggctccgaatactggagaattgtacgattggaatcagcatcttatcgatgagggatttttggtgcttgccgggaaagtgaggaaggaagaagaaaatgacgagataatacaagtgttgcagaaacactggcaaagaaatatcgtgttggaaaacttgttttccttgcataaggatacatcgaccgtaaccaaaacagtactacaaaaaatatacgataatcgtaccaagtatcccaacattgttatgacatttaatatggataagatggctgttctggtgtccaaagctttggagtttaatgaaccagttctgttagtcggcgaaactggtggaggcaaaaccactatttgccaactgatagcggatgttaacgatcaggaattgatttctctcagttgccacatgaataccgagagcagtgattttatcggaggtctgagaccagttcgtgaacattcaaatgataatcggctgtttgaatgggttgatggtccattgataacagctatgagaaagggaagcgtgtttttggccgatgaaatatctttagctgacgacagtgtcttggaaaggttgaattctttgttagaacctgaaagaacactgctacttgccgaaaaaggagtcgatataaacgacataaataactcggaatccattacggctcatccgaagttctgtttcatcggtaccatgaatcctgccggtgatttcgggaagaaggagctctcgccagctttaagaaatcgttttaccgaaatatggtgggataattcctcgttgactgatttacgtcatatcatcaagcacactttaaaagcgaaagagacggattttgatattgcttcgagtatgtgcgatttcttaagttggtttggatgtagtgacgttgggaagagatatacagttagtataagagacgttataacttgggcgaatttcataaatttggcgtcaaataatttaaatgctattgaggcatatgtacatggcgtgaatctagtttttctggatagttttggatctggagtcactagcgctgagagttgtaatgttctggataatttcaaatctaattgtatcaagcatttgtttccccggccagacgcgatgtttttgaatgataaagaaaatgtgagcaagtatggatgggaaaagatgaaatgtattgttaaagaagatatatcgaaaggagatttctcatttactgtaactgatcaacaattgggcatacatccattttacatcggcatgggcgaggaagaaacatcagacatcacgttttcttttgatgctcccactaccagattcaacacttttaagattttgagaggaatgcagctgaataaggctattcttttagagggtagcccaggcgttggtaaaaccagtttggtgacagccctggccaaagctacgagacacaaaatattcagaatcaatttatccgatcaaacagatatttctgatctttttggtgcggaccttcctgtggagggtggaaccggcggccagtttgcttggagagacggtccgttgctccaagcgctcaaagataggtgttggatactccttgacgagctgaatctcgcctcgcaatcggtgttggagggtctgaatgcttgtctggaccacaggggcgaaatatttataccagaattgggtaaaactttctatgttgaacctggaacccgattttttgcttgtcaaaatcctatgaaacaaggaggctccaggagaggtttacccaagtcattcttgaaccgtttcattcaggtgtacattagtccattcaattctgaagacatggaagtgattctcttgaaacaattcccgtctttgcctaaagagttgattcagggaatgatacggtttaactctaaattgacaaatgaattagagagccacaatttcggactgaagggctctccttgggagtgtaatctacgtgatttgacccgatggtgcgaagcgacgctgtaccactacaattccaacggatcgcgcgagtacagcccggaaagtaccgtccagttaatttatatggacagaatgcgattgagagatgataaaaaacgagtgaaggatcttttcgctgaagtaatgggtcgtgaaattaaggggtcccaaccggtagcgtacatcaataaagagaaagtgtttttcggtgattcatccatcgatagatcgatcgttggactcaacgagaatgttctggaggataaggggtatttgatcttgagatgccagttgggggcgctgaggagtttgagttattgcgtcaatcagaactggatggctattctggttggaagttctggcgttggcaaaagtagcgtggtgaagacactagctagtctggctgggaaaacattgagaactttaccggtgacatctgcgatggatacgacggacatcttaggaggctttgaacagacgaactacacccgccacctggaggaacttgtccaagaagccgaacggcgaactttagtcgccgttaaggaccttctgctggaagataatatcgtcaatgccgtgaaattaatggaatgctgggaggcgtacttgtccatcggcgattcgaaaacctatacattagaggaggaagttcagttatttttgaacaaagttaaaatgatcgagaacctgttgatccagctctactcgaaatgtaacagttccgaggagtgcgtgaacatgcaggatctattgaacagatgccagcatatttacaatagcgttaatgaagagaaatctctaagtgctggcgggagatttgaatgggtgaattccgtgttagtaaagtgtctgcaagaaggatcctggcttctcgtcgataacgtgaatctgtgtagcgccgcggtattagatcgcttgaatggcctcctcgagccaaacggcacgttgacgatatccgaacggggtatgaacaaggaggggaagatgttcgaggtgaaaccgcatagagattttcggatctttttgacgatggacccaaagaacggtgaaatatctagagctatgcgaaacagaggcatcgaaatatacatgttaaacgatctagaggacactacaagctctaaccagtacgatttaaaaagcctcgtcgctaatgagggcctatccgatccccaagacatcaacactttaatcaaaatccaccagttcatttcgagcttgattgtaagcgacaaacccaaccataccgacatattacgatgttcctcgctgattgccaagcagattgaccacagtatcccactggacgaagccttttacaccacctgcgtcgaggtatattacaaaacgcgcacctcgtcagaattcaactgcaacaatatcctggaggttatcagagacggagtgaatcgatgcctggacgagcgagcaactgacgaacgtgatctgttcagtaaaaatgcgaccatcagcactagggatctccccagatggtcggaatatgttaaaacaaagttcgagatgtgtttgtataaaaaagtcatggaggacttttctaataacttcgatatagccaagaaaaatctgtatgatggtgtagataaaactaaagtaaccgcgaacgagtatatagacacgttgtcaaagaaagatcggttattggagagcaaggatttatcggtttggtcggatctggagtatatcaagctccacaccaaattattggacgatattgacttctataaagtagcaaatctcttgattaatagctatatgatgagctctacagataatctcgaacacaagaccctgcatcttaggaatattgttccaaacaaacaactagatatatttttgaattatttcagcaaattagtgaaaacttgcggtactaccacgaatcgtttaccgttagactgtagatggataaataaatattcccatgatgatgaggactcgtttgattcgataaattacgccttccagatcgaactgcattcactacgagatgaatttgaaagcacatacacagacagtaggtctttatacaagtcagtatgccttggatttcagaaaacctcaacgaaaagcaacaggagaatcagcgagtcatacctgctgaagaattctctgttctcgaagtactgcgatctaagataccgttatttctccttcttgcaccaaccgcgcttcgaaaacccaccgaaaggtgccgactgttttgtgaagactctggacttgttaagttggagacaagcactgcactcgttcctcaccaacgtttacattgagtggtcttgggacgatcgagatatagcgagaaaactagacacgatgactgtttattataaatggttctacaagtactccattaaaggaatttccgaattgttgtccttaaatgttccggaagactttcagaccattctcaatgatataaacaaggaaattcattatttttcgcgggactataagatattccacgcctacaggaagctaaacaacgttccagaatcgttgaagtatatatggcagttgtcagcactacaggtcctgaacagctatgatttttcggatgcttgcaacgatatatcaagaataatttgttatttagtccagaacagagatcaaagacatcttctccagaaaataaaacttgccgtatactcgccaaacgacaaaaacgatgacgtaagcgcgatccagaattttaacgaacaggacaacgataaaaaaacagatcttgatgaaagcgtgatgcagatacttcctctgggagacaccatgatacagatgatgttacttcgcttgatggcttatgacgaatccacttttaaaactgacagcttaaataacaccttgattcccattgaattgagtgcggcattgcttgactacaaaaacaacgaaaacacgagactgacgcacgaaatcaggaaaggattttactcgtcagccgtacgaaatgcctcagtgatgcctggggtattcttaaaggaagaaacatcaagttctacgtttttagttgccggtatttgcccgatgtattcctacttgctcaacaggttgttagatcgagaatccataacgttacagaattatagaaccgttgaaaaacaacgaggatacgttggtttgctcatgtggaaaaacatctacgccgtttcggacaaaagcaacgatttcctatcgatgcaaatcaaactcgtgcaggaccacgtcaataactttctgcagcgtctagaagaggctgaattcaaaattggacacccttcaacgtccaaaatagaaggagtctcctccatcgtaaacggttccgtatcaaaactcgtcgaattaatggtaaaattgacgtcaaacatcggagacacggaagacgaatgttttgaggacaccatatgtcgtatagccgatttacatatgcttcttgggtacctggagggttactttaactccgcccttcccaaggtggatcctctcgcgaagaaagccatgaaaaagaatcatttaaattcggtgatcagcatgtttaaccagatggctgaaagttaccgattaacagccaacctgctcagtaactacgagaattgttatcatccgtattaccaggccatcagagatcacgttaaattgctcgaagataaagttaaaaagtacggagatggcacaactagtggtgttaaggcgcacccttacagttacgttatccagcaaatcagacacgccttcgatggagtactcaacaggaaacttatcaccgatgccctagacaacagcttgctggaaaacttgaaatctctttcggacgtaagcgagaatcgcatccagcgagccgtccgtcacatagaacgacttgagacgagtttacccagtttcgatcgcatcatacacgaatggaaaacgtatcgctgctcttatccagacattgtcgaacccctattagccaatgtggctcagttacgttacggcttgcatctgaaactttactgggcgaggcgggaactcctgaaatacaatcacagagttcggtttaatttggatttggaggaggaattagtccgactcgtctcgttcccggctttaaatgaaaccaccaccgatatgggcgactacatagacaactacacgcatggaagtataaatacgttcattcataaggttttagaaaaaggcgattatgttagaaagaaggaatatttgagattactaaaatgtggcattcaggactatttcaattacaacgttatcaaagctaagaatggtggaacattggataaaaccataatggccaaattcaataatttattgacttgttttgtgaacttatggaatcaacaacgcgaacatgaggaacaggaacagcaaaaatctgcaagcctctaccagataaaaaccaaatgtgacgataaatccgaacatgaacaaatcgatgacgaactgaatgaaatgttcaccaactaccacgttagtgacttcgctgatttacaggatactggattaacagacagtcctccttcaccaccagaaataattccagacagtgttaaagctattaccgaagatgatatacagtatgtcatcgacctgcactctatcctcctcaataactttacgaaatctgaatggatatctttgaaatttgataagaatatagtgccggactttacaacacccctactggagagattcaagatagcacgactgataaccgacgaatactcgtccaattttaagtatacgacggatttgagtctgtttggcagtttaagcgtacttttagatggcgtacgacgattcctggttgctgaaatagattgtactgcaaatacgaacaaagatttctacaaggatgctgatgtagaagaagtgaagaactgctatcatgttcttgatgaactaaaagctaaagtcaaggagctcttgatggaatggccagaccaaccaacattgaacacgatattaacagtaattgatcgaatcgtcaatttcgacataaccagtccattatcccggtttttgacgggattcgatgtccttctacaaaaatgtcacgaatgggaacaggtagcgcactctggcatcagtctgatacacttctcgccaaatcttacacaacaaataatatcctggcggaagattgagctaaacaggtggaaggatttattgaacagtacattccaagatatgaaaaaatcggtgagaaaatggtggatatacatgtacaacttaatgacccagtatacggccgaggagaaagtgtctgaagccgatctgatcgacatcctcgagaaattcatctccaaatctccgctggccgagttcgacagccgcctgaatctcatctttacgttccacctccacgccatattcctaacgaagacaacgcgcaccgaatccttcatcaacatactctggaacgtgtaccactactttacacagttctcgtcgaccattgcccaaaaggtcaaggacgtacgaatgccaatcgagaaaaaattaagagaatacgtgaagatcgtaaggtggaaggacgtcaactactggtccatcaaggacactgttgataaaactcacaaggctttgcataaatccgtgcgagagttcaaggaagccatgctacaacctgtgacaacttacttatacagtccgtcagcggagaactcgatagagagcatcggcgtgtgggacagacctcaacgccaaaatcccaaagcttatcattatacgctcgatcccgactcgtacgtcattaaggctcctaataaggacgttcccttcctcgccagagcgcgaaagatatgtaaagaagcaatctccgagaccgagtatccccttttggtaaaaaccctcgacggttttatcaccgacgtcatcgagactagttcccacctgagaaatcttgaggtcgatcggactttacccaaggaaaaacaggtatctcaggcaaaaagcgtcctgcaacagaaacaccgggctctggcggaccttttccaagccctgtccaagatgggcctctcgtacaagaaaggtatagtcgatgtgaagctgaagcgtgtctgcgagaattttaccacgagccccgtcaatttggccgccagtttcgatcatttgatgcacaacagattggacgagaaaattttaactgtttgggattcgtgcgagatgtattattacaagtgcctcgcgcgtttcgatatattggagaggtctctggttaaccccgcgaaggatttgggcatgcccaacattgagagatgcagaggatttgctacggaacttttaacgtactgccaataccaaaagaaaaatctaacccaatccacacgctcgtactactatctccgcagctacagcagactaattcacgagacttgtcataactcagactacattaccgtagaagatttgacggaaatccaagaagctataaattcaacttgtatcgtaacgacacaaatcaaaaccatcctagagtcttgtttaacggaacaatcgatggagtcctatttgatcgatataccaacgatcgaaccgacatataacaaaattcggtacagaaatgacgattcttggcaatcggcgatgaaagacgtcgatgagatacactccgctgtgaagcgactgtcgacccagttaagaaaaacggaaaacaagttgccttgtgtcgaacacgtgcctgtccaagttcgatttttacctcagaacaacagagctcaaatgttcgatgatgtaaagacgttacgtgaacatttaagtggcttgagggtcgtcatgtatccaatttctgtgacaaacaccatcgattggctgataaaaacgttcgataagataatggagaagaacgacggaaatgtggaggaccgacacattactaacgcggacacaattttacaagaatccagtgactctatcttaatatcgattcagaatatttataagaaatatcgcggtcttaacttgaacaaaagctttgatgaagatactgatgaggccataagagaaaatcatctgaagtccttgataatggagaacctggcgtccgatgtatcttcattagacttaaataacatactgaaacatgtggaagaactaatcaaagttcttcttggcgatgcagcacaacccaccgaaagattaaaatcaatggcggcacaatatctcccacttttggatcaagtgttgcaacttactcattattttattacccaacaagtatgtgcatatcgcaccacttgtaagttaacatcagtaatcctgaatatattcaacgatttatcaacaaaaggtttttgcatacctcccgagttgagtgaagaaatggacaaagaaggcatcagtaaaccctctgacggtatgggattaggggaaggacagggtgagcgtgatgtctcggacaaaatcgaatctgaagatcaattagacgatgcacagccggctgggcaagagaaagaaaataatgtggaccccgattgtaaggaagaagataaaggaatagaaatgagcgaagatttcgatagcaaattacaagacaaaaaacctaattcagacagtagtgatgaggagagtgacaattccgatgctgacgaacaaatgggagaaaccgaaaaaggagccgatcaagtggaccaggaaatctggggagacaaggacgacaatcaagacgaagatgaatcagaagagaataaagatgatggcaccggaggggaaaaagatggtgaagatcaattgggcgctaagaatgaaaattccaaggacaaacaaaagaaacagccagacaaggagcaaggtgaatcatcggagaaaaaggacgacatcaacgagatgaaggaacctgagtatgacgaacagcaagtcgatccgtatcacggaaatcaaccggaacttccggaacctgaacccatggacttacccgacgatttgcaattggacgaaggagaagaaaacgacggtgaaaaagccgaagagaatccatttgatatcgatgaaaataaggacagcatggaggagatgcccaaggatactggcgaagacgacagaccagataaacaaagcgacgaagttgacgaatttagtagcgacgaagaagatactaaaaacgataacgaaaacttggaccgtgaacaggtggaaaaagatgaaataatggaacaagatcaaaataagggtaaagatatggaaaatgagccagctgaggaagatcctgaagccagcgaagagaaccaagaaagcggtttggacgaaaatgtcaccaatcaggaaaatgttgaagccatggaaactgatgatgcacaagccactgataagacacaagcatcaaacagcgagaacatgaagtccaaccagccgatcgacgaactgaaccaagaagatcgaccagataaagatggagttggacaatctcaaatggaagaaagtgatactggtcactcagcacagaccagtgcggctgatcaagtaaaaggttcaaacatggaagaggaggtaccgcagaagaagaaagaaaaaccgggcgtttctgattcaaagcgcagtttaggcgacgtagaccagcctgtccagaagaggctgaagactattgatagtcaaactgaatcaaccgacagagacgaacaagacgatgatagagcccaaatgtatgaacatatcaaagatgccagtgaaatgacaaaaactcagactctagatacagcaacaagagaacaagctgaagaacaaaagaaaaccgtcgaaccgggcgaggagactgaagacgacgacgaaaatatcgagggaagcgaaaatgtccctgaagaagatgaggccatggacgtagatgtggctgagtcacgaaaagacttggcggccaagactgaggctaacaaagaaataatcaaaaataaagcccaacatcctgaaggtgatatagtggatgatgttaaggaaactgagattgaaggcgaaattgtaccaacgaatacagttccaaggggtgatgaatcatcctatcacactcaatttgagttactgaaaacctatgatggtaatatagatgaagagatcaacaaccgtaggaaggaagttgaggaacaactatcctcttggaaaacctcgcctgtttcagctgaggctgaagtggcctggcaaaggatatcgtcgatcacctcaaccttagcccaagagctatctgagaaattaagactgatactggaacctactcaagcgagccgtcttaaaggggattacaggaccggcagaaggataaacatgcggaggatcatcccgtacatagcatctcaattccggaaagacaaaatatggatgcgacgaaccaaagcctccaaacgagagtaccaaatcgtgctggccatcgacgattcctccagcatggccgataaccactccaaggagatggcatttgaatgcgtgtccctcatatccaaagccttaacgttgctggaaagcggacagttggccgtcgttggtttcggggaaaccacggaggtacaccataaactcacggaaccgttcacggaaaacagcggcgcgcatttactacaaaagttccagttcaatcagcagaagacctgcgtgggagaattgatgagtttcgttacggagatgttcgcgcaacaaggcgccccagcttccgtagcgaccgccaagctgctgctcatagtcagcgacggtaggggcgtgttttccgaaggaaaaaccttcgtcactcgcgcggtgagaagagcgcagcttcaaaatattaacaccgtgtgtatcatcatagacagcccggaaaacaaaaactccatactggatatcagaacaacagtcttcaaagatggcaagttttacgggatacaaaactacatggatgagtttccgttcgctttctacattatcctgcgggacgtcaacactcttcccagggtgttgagcgatgctttgaggcagtggttcgaaattgttacctcagaatttac

SEQ ID NO: 345 - DNA, 512 bp, Rhynchophorus ferrugineus
gtcattaaaaaaaattgatcaagctcctgaagtaaatagaaacccaataatccctaaatatgtagaatgttctttgcatgtagttgatgtatcaggcatttatatatcagctgctgatgaacctaaaaatggtatactagtagatgttccatccacttttaacaatttaaggaagattgctcttggcttattatccagcaaggcattgtgcctcctaggccctgttggttctggtaaaactgctttgatagaacatttggctctggtaacagggcgaaagttgggtgaggattttattaaaattcagttgggagaccaaactgatagtaaaatgttgcttgggacatatagttgcactgatataccaggggagtttgtatggcagccaggagtcttgacacaggctgtcattaatggcaattggttgttgatggaggacattgatctcgtcaatgtggacattgcctcagtgttagcgtcgttactagaaaacaacgctctttcagttccgg

SEQ ID NO: 346 - DNA, 1227 bp, Rhynchophorus ferrugineus
ccttaaagtaaattgtaaatgacagagaacatatgaagctagatttaaacggcttgtcaaaaatgtcatagttcatgatttgcaagtaatacactaaacaaaagtcaccgtttgatctcaccaagtttctcaccggccgaattgttgttttgtttgcgtataaaagagagtgtaattgtttatttacgcaatggatagattactacgattgggaggaggaatgcccggcttaagccaagcaccacctccgagtgatgccccagtggttgatacagcggaacaggtttatatttcttccttagctcttttgaaaatgttaaaacatggtagagctggtgttccaatggaggtcatgggtctcatgttaggcgaatttgttgatgactatactgttcgcgtaatagatgtttttgctatgccacaaacaggtactggtgttagtgtagaagctgtagatccagtgtttcaagcaaaaatgttggacatgttgcgtcaaacaggtcgtcctgaaatggtagttggctggtatcactctcatccgggatttggttgctggctttcaggagtcgatattaacacccaacaatctttcgaagcactatcagaaagagctgtagcagttgtggttgatccaattcaatcagttaaaggcaaagtggtcattgatgcttttagattaattaatccaaatatgatggttttggggcaagagcccaggcaaaccacatcaaatttgggacatttgcaaaaaccatctgtgcaagctttaatacatgggttaaatagacattactattccataagtataaattataggaaaaatgaattagagcaaaaaatgcttcttaatttgcataaaaaatcatggatggatggtctaaccttggcagattattcagaaaattgtacaaccaatgagaaaactgttgcggatatgttagaattagctaaaaattacaacaaagctcttgaagaagaagaaaagatgaccccagagcaattagctattaaaaatgtagggaaacaagacccgaaacgccatttggaagaaaaggttgatgtactgatgacaaataacatagtgcagtgccttggggctatgttggataccgttgtatttaaataacaaaatacaaattatgttactgtgtgaattcatttttttaagtatttaattgtacttttttgtgaaattaaattacttcatttctaataaaaaaaaaaaaa

SEQ ID NO: 347 - DNA, 1153 bp, Rhynchophorus ferrugineus
gtcaaaaatttatttatcatctttactgtttgcaattaaagaaaagaaaaatgccgagtcaagacgttacaactaataaagtggtggttcaccctttagttttattaagtgtagtggaccattttaatcgtatgggaaaaatcggtaatcaaaaacgcgttgttggtgtattacttggttgttggagggctaaaggtgttttggatgtatcaaatagttttgcagttccatttgatgaagatgaaaaggataaatctgtatggtttttggaccatgattacctagagaatatgtacggcatgtttaaaaaagttaatgctagggaaagggttgttggctggtatcatacaggaccaaagctgcatcaaaatgatatagcgattaatgaattaattcgcagatattgtcccaattcagtccttgttataattgatgccaagccaaaggatttaggtctacctacagaagcttatcaagcagtagaggaagttcatgatgatggctctccaacttctaaaacatttgaacatgtgcctagtgaaattggtgcagaagaagcagaagaagtaggtgtagaacacttattaagagacattaaagatacaacggtgggtactttatcacaaagaattaccaaccaacttttgggtttaaaaggtttgcattctcagttgagagatattcgagattatttaattcaagttagtgaagaaaagcttcctattaatcatcaagttgtctatcagctacaagatatatttaacttattacctgacattaatcaagttcaatttaataagtcattctatgtaaaaaataatgatcaaatgttggtagtttacctagctgcattagtgcgatcaattgtagctctgcataaccttataaataataaattaacaaatagggatgcagaagaaggcaaaaaagatgacaaaaaagaaaaggaaagtaaagataaggaaaaagaaaaagataaagataccaaaaaagaggagaagaagaagtaagggggtttcatttgttcatacctttacaaaacgaattatattcatagattattttatgtaacattaatacaacataataaaacacatttcaatgaaaaagaaaaagataaagataccaaaaaagaggagaagaagaagtaagg

SEQ ID NO: 348 - DNA, 920 bp, Rhynchophorus ferrugineus
aatacaggctatttggtgtgattgtttgagattgtttgtaatcatgtcacaaaataagggtattcgaaacgtaaaatatttgaaaaaagttattatatcttcggatgtatatgccgtatgcatagaacatgcacttacaaatgaaagtcaggaaattatgggattattggtcggcgagatcgatcaaatagaatgtgttacaactatacatgcttgtatcatattgcatcgcagtgataaacgaagagatcgtgttgagatatctccagaacaattatgtaatgcgtctatacaagcggaaaagctttgttcaatattggatagacgtgtacagattgtaggatggtatcattcacatccccatattacaataaatcctagtgttgttgatattagaacacaatctacatatcaattgatggatccattatttgttggattaatattttcagtatttacttataacaagttaatgcatgatcatagggtggaggtgatttgttttcaagcagatccagatgaagagaaagttgatgtacctttaataatcaataattcaccaatgaaattatgcaatttggaagcaatatgcaatttgcccaaaatattaatagaggaagaagttgagagtcacaacatcacaaataatgatactaaagatccaattactaaattgcataatgaagcgtgcaaaactttagctgtaacacatatagtatcgaaactgtctaggcccttatgtgaagctctaattgaacgactaaatgccaccaaattgaggattaaagaacttcaagccattaagaacaaattaacaagataaaataattgcttattagtatatatatactcatttttaatataagataaaactgttataacatttatattttatattgttaataaatttgtttaaaaat

SEQ ID NO: 349 - DNA, 7151 bp, Rhynchophorus ferrugineus
tgtctgcattgtttaaagccacctgctccaaaacgtcgctggtatcgaccaatacgcgcaggtaattaaaggtaacagcacttgatttttgtgactgtgcggtgtgcactgacgtgactgacctgcaataaaaagtgttagtgacacgaaccggatagcgagcgtgaaagaaattaattcaaacgatgtgcgggtgtgaattaaacgaataagggcttcacatatcatcagaaattgtatatgtcaagcctagtacaaaatggttattgttactcggggtgattatatctggattgaacccgtgagcaatggagagttcgacgtggccatcggagctcaagtgctgcaagctgaaggccgtcgggtctacgtacgagatgacgatggtcgggagcactggttgtctcccgaccgtcgcatcaaggccatgcatgccacctcagcgcatggcgtcgaagacatgataggattgggggacctccacgaagctggcattttgaggaaccttctcatcagatataatgacaatataatatacacgtacactggttctattcttgttgctgttaatccttatcaaatcctgcccatttatacagctgaacaaatcaaattgtacaaagaaagaaaaattggagaactgccacctcatatatttgcaatcggtgataattcctatgggaacatgagaaggtatggacaggatcaatgtattgtcatctctggagagtctggagctggaaaaaccgaaagtacaaaattaatattgcaatacttagccgcgatcagtggcaagcactcatggatcgaacaacaaattttagaagctaacccgatattagaagcttttggaaatgcaaaaaccgtaagaaatgacaatagttccaggttcggtaaatacatagatattcacttcaatgcaaacggcgttatagagggagccaagatcgaacaatacctattagaaaaaagccggatagtgtcacaaaatcccgaggaaaggaactaccacatcttctattgtttgttagctggcttaggtaaagaggaaaaaagaaaactggaattgggagatgccagtcaatacagatacttgactggtggtggaagtataacctgcgaaggtagagatgatatagcggaatttgccgatataagaagcgcaatgaaggtgttgctgttttccgatcaagaaatttgggaaattatgaagttgttggcggcgttgttacatataggaaatatcaaatataaagctacaattgtcgataatcttgatgctacagaaatcccagatccaaccaacgtacatagagtagccaatttattaggtgttccggttcaacctttaatcaatgctttaacccgtaaaactttattcgcacatggtgaaacggttgtttctacactctccagggagcagagcgtcgatgtcagagatgccttcgtcaaaggaatctacgggcgattgtttgtcttcatcgtgaaaaaaattaacgctgccatctacaagccgaaagaaagacagagaagttctataggcgttctcgacattttcggtttcgaaaacttcaatcacaacagttttgaacaattctgcattaattacgccaatgagaatttacagcagttcttcgttaggcatattttcaaattggaacaggaagagtataatttggagggtatcaattggcaacacatcgaattcgttgacaatcaagacgcgctagatttgatagctgttaaacaattgaacatcatggctttaattgatgaagagagcaagtttccgaagggcactgaccaaacaatgttggccaaactacacaaacaacatggaactcaccgaaactacctgaaaccaaaatctgatattaacacaagttttgggctaaatcatttcgcaggtgttgtattctacgacaccaggagttttctagagaaaaatcgagatacgttcagtgcagatctactccaactagtcacagtcagcaaaaacaatttcttacagcagctattccatgacgatattggcatgggatcagagaccaggaaacgagcgcctactttgtcaacacagtttaagagatcattagattcactcatgaggacattgtccaattgccaaccgtttttcattagatgtatcaagcctaatgaactgaaaagacctatggtatttgataggaccttatgctgtaggcaactaagatattctggtatgatggaaaccattaggattagaagggctggatatcccataagacacacatttggtgaatttgtggagagatataggtttttaattcacggagttcccccagcgcataagactgattgcagagctgctacttctagaatctgtcagatagtattaggtagatctgattaccaattaggcaacactaaagtatttttaaaagatgctcacgacctatttctcgaacaagaaagagaccgtgttctaacacgaaaaatccttatattgcagagaaatataaaaggttgggtttatagacgccggtttctacgatacagggcagctgctattactatccagaagtactggaagggatatattcaacgacaaagatataagaggatgaaagtgggctacatgagactacaggccctaataagagctagagtattgtctcataggtttagacatcttagaggacacatagttggtcttcaggcacatgcgagaggataccttgttcgtagagaatatggaaacaaaatgtgggcaataatcaagattcaatcccacgtcagaagaatgatagcacagcgaagatataaaaagatcaaactcgaacacaagaaacacgtggaggctctcaaattaaagcaaaaagaagagagacaattaaaggatgccggtaacaagagagcaaaagaaatcgccgaacagaattaccgagaacgtatgtacgaattggaaagaaaggagatggaattggaattggaagagcgtaaacgagtagaaattaaaaagaacattatcaacgatgcagcgagaaaagccgatgaaccggtagatgattccaaactcgtcgaggctatgttcgattttctgcccgatagttccagtgaagcaccgggtcctgggcgtgaaacatccgtctttaacgatctgccaacgcaatcaaatgacaatgaaattattagccccattcaaactgtgtcggatgacgaggaagatttgagcgaatttaagttccaaaaatttgccgcaacatatttccaagggaatattggtcatcaatattccagaaaacctctaaaacatccgctacttcctctacatactcaaggagatcagctggctgctcaagctctttgggtcaccatacttagattcactggtgacctaccagaaccgcgttatcatactatggacagagataacacatctgtaatgtccaaagtcacagctacattaggaagaaattttattaagagcaaagaattccaagaagctcaaatgatgggacttgatactgactcatttttaaaacaaaaaccacgatcaattcgcaataaactggtatctttaactctaaaaaggaagaacaaattaggtgaagacgtcagaagaaaactacaagatgaagaatacacggctgacagttatcagtcctggttagaatcgagaccaaccagtaatttggaaaaattgcactttattatcggtcatggtatattaagagcggaactcagagatgaaatttactgtcagatatgcaaacagttatcaaacaatccgtcaaaatcttcacatgcgagagggtggatattactgtcgttgtgcgtaggctgttttgcaccctctgaaaaattcgtgaattacttacgaggcttcatcagagaagggccgcctggatatgctccatattgcgaagaacgtttgaagaggaccttcaataacggcactcgtaaccaacctcctagttggctcgagcttcaagccactaaatcaaagaagccaatcatgttaccgattactttcatggatggaaataccaaaacgctactagcggattcagcgacaactgccagggaattgtgcaatcaactgtctgataaaattggtctgaaggaccagtttggattctccttatacatcgctttattcgataaagtatcctctctaggtagtggaggtgatcacgtcatggatgctatctcacagtgcgagcaatacgccaaagagcaaggcgcgcaagagaggaacgcgccgtggagactgtttttcagaaaggaaatttttgctccatggcatgaaccaaccgaagatcaagtagccacaaatctcatttatcaacaggttgttagaggagtgaaatttggagaatacaggtgcgataaagaagaagatctggcaatgatagctgctcaacagtactacatcgaatacaatactgacatgaacgtagaaagactgttgacgttgctcccgaattatattcccgattactgtttaacgggcgtcgagaaagccgttgacagatgggctgcactggtcgtccaagcctacaaaaagagttattacatcaaagagaccgtcaacacattgaaagtgaaagaggacgtagtcagctacgcgaaattcaagtggcccttgttgttctcccgtttctacgaggcttacaggaattccggccccaatcttccaaagaacgatgtcataatagccgttaactggacaggagtgtatgtggttgacgatcaagagcaggtcctcctggaactatcattcccggagattaccacagtatccagtcaaaaaaccaataaggtctttacgcagacattcagcttgaacacagttcgaggggaagaattcaccttccagagccccaatgcggaagatattcgcgatttagtggtgtacttcttagagggactgaagaagagatcaaagtacgttatagctctccaagactacaaggcaccgggagaaggttctagtttcttgactttccagaaaggtgacttaattatattggaagaagacagcacaggcgaaacagtcttgaattccgggtggtgtgtcggacgatgtgaaagatcgcaggaaaagggcgatttcccagcagagaccgtatatgttctaccatgcatgagcaaaccaccatcagacattttgcagctgttctcagtagaaggagtaaacgagcataatcgacgtttaagccaccactcaattaacggaatagaaactcgagataggcctcatacattggctgaatattcgctggaccatttccgtcagccggccaagcgaaccgtatcgaaagccttaacgctaagcggtggtagacgaggaggaatcgatgaactctggagacattcaagagaacccattaagcaaccgttgctgaagaaattgttaatgaaagaagaattggcagaggaggcatgttttgccttcagtgctatactgaaatacatgggtgacttaccatcgaaaaggccgagactaggaaatgaatacaccgatcatatattcgacggacctttaaagcatgaaatactccgagatgagatctactgccagataatgcgtcagctaacggacaataggaacagaatgtccgaggaaagaggttgggagctcatgtggctggcaacaggtctcttcacttgttcacaaaatctactaaaggagctgactgcctttttacgaaccagacgacatcccatatcacaggattccctccagcgactacagaaaacacttagaaacggccaaagaaagtatccacctcaccaagtggaagtggaagctattcaacacaaaaccactcaaatattccataaagtctacttcccagacgacaccgatgaagcctttgaagttgattctagtaccagagcgaaagatttctgccagaacattagccaaaggttgagcctcaggtcaagtgaaggcttcagtttgtttgtcaagatagccgataaagtgatatccgtgcccgagggcgatttcttcttcgattttgtcagacatctaacagactggataaggaaagctcgtccttccagagacggtataacgccacagttttcttaccaggtgttcttcatgaagaaactttggaccaataccgttccgggtaaggacagattcgcggaccttattttccacttccatcaagaactgcccaaactgattcggggctatcacaaatgtagcaaggaggaagcgtttaaattagcagctctggtgtacagggtacgatttggagatagcaaacaggaattacaagctataccacaaatgttaagagatctgataccggctgatctggtaaaaatccaatcagccaacgactggaaaagggcaatagtggccgcctataatcaggatgctggtatgtcgccggacgacgccaagattgcctttttgaaggtggtataccgatggcccacgttcgggtcggccttcttcgaggtaaagcaaaccacagacccaaactaccccgagatgcttctcatcgctatcaacaagcacggtgttagtcttatacatccacaaactaaggacattttggtaactcatccattcacaagaatttcgaactggtcatcaggaaacacatacttccacatgaccattggcaacctagtcaggggatcgaagcttttatgcgagacctccttaggctacaaaatggatgatttgctcacgtcgtatatctccctgatgttgacaaacatgaacaaacaaagaagcatcagaattaaatagaaattcctgccttgaaattgagtgaacatatgacctaaaagctccaaaacagatccgtagatctctattggtatattgttaagttttattttatatcgtaaaaatgtatttattatcatttcttttaatttgaatctcccaaaatggaaagtttcgaatagttgtgattccatagcttttaatttttattgaggctcagtaagaaaaaaataatgaaaaaaaattatatttttcgagtttgtatttttacaggctttaatttttattattttatattgtggtgaatttttgtagcttttaaatttgtatctattcaaatatttatatgtatgtaaatattataacatcactatgattgctgtaatatataaatattccatgaaaataaaat

SEQ ID NO: 350 - DNA, 7344 bp, Rhynchophorus ferrugineus
caaaatgtgcgcgatccacaatatcaaaatgattacgtcaagatggccgctgcacgattatactaaaatataacacgttaaatgcgttgtcttttacgtttactttgctttgctatataatttttattacaaatgtgccggttatattttaaaagtgtttaattaagaaataaagagacaaaatgtccatgccaccgtatctgttgggtccaaatccctgggctcaaatgatggctcaacaacaattggctgtagcccatgtggctgcagctcaggcccatgcccacgctttacagcagcaaatgccacctccgcatcccaaatctgatgttatgacggaagataagcttcaagaaaaagcacaaaaatggcatcagcttcagtcaaaacgtttcgcagagaagagaaaattaggttttgtagaggcacagaaagaagatatgcctccagaacatattcgaaagattattcgtgatcatggagacatgagcagcaggaaataccgccatgacaagagagtttatttgggggcattaaaatatatgccacatgcagtgatgaagcttttagaaaatatgcctatgccatgggaacaaataagggatgtcaaggtattatatcatattactggagcaattacttttgtaaatgagattccttgggttatagaaccagtgtatatagcacaatggggaacaatgtggataatgatgaggcgtgaaaagcgcgatcgtcgtcatttcaaaagaatgcgtttcccgcctttcgacgacgaagaacccccattagattatgcagacaatgtgttagatgtagagcctttggaagctattcagatagaattggatgcagatgaagattatgccatcgcaaaatggttttactatcacaaacctttggttggaacaaaatacgttaatggtgcgacatacagaaaatggaatttaacattacctatgatggcgactttgtacagattggcgaatcaactcttaactgatttagttgattacaattatttttacttgtttgataccaagagtttcttcactgctaaggctttaaacatggcaattcccggcggaccaaagttcgaaccccttatcaaagacatgaaccccgctgatgaagattggaatgaatttaacgatattaataaaatcattattcgccaaccaattagaacagagtataggatagcttttccttatttgtacaacaacatgccccattttgtacatttatcatggtatcacactccgaacgtggtttatattaagacagaggatccagatctaccagcgttctatttcgatccacttataaacccgatatcacatcggcacgcggtaaaaagcctggaacccttgcccgatgacgaagaagagtttgtattacatgaacacgtccaatctttcttgcaagaaacaccattatataccgataacacagcgaatggtattgcgttgctctgggctcccagaccatttaacatgagatcagggcgtaccagaagggctattgacgttcctttggtgaagtcgtggtatatggagcattgtcctcctgggcaacctgtgaaagtgcgagtcagttatcagaaactactcaagtactacgtgctaaatgctctgaagcacagaccacctaagccacaaaagaaacgatacttgttcaggtcattcaagtcgaccaagttcttccaaaccaccacattggattgggtggaagccggtctccaggtatgtcggcaggggtataacatgctgaacttgttgatacacagaaagaacttgaactatctgcacttggactacaactttaatttgaagccggtcaagacattaactactaaggaaagaaaaaaatctcgatttggcaatgctttccatttatgccgagaaattttgcgtctaaccaaactaataattgattctcatgttcaatatcgattgaacaacgttgatgcctttcaactagctgacggcttacagtatattttcgctcatgttggtcaattgactggtatgtacaggtacaaatataagttgatgagacagattaggatgtgcaaggacttgaaacatttgatttactatcggtttaatacaggtccagtgggtaaaggccccggttgtggattctgggctcctggatggcgtgtttggttgttcttcatgcgcggtattacaccgttactggaacgatggttgggcaatttattgtccagacaatttgaagggcgacattcaaaaggtgtcgcgaaaaccgttacaaaacaacgagtggagtctcatttcgatctcgaattgcgtgcttctgtaatgcacgacatcgtcgacatgatgcccgaaggcattaagcagaacaaagcacgtactatattgcaacatctgtctgaagcttggagatgttggaaagctaatatcccatggaaggttcctggactgcccattcccatagagaacatgatacttcgttatgtaaaaatgaaagctgattggtggactaatacagctcactataatagagaaagaatcaggagaggtgcaactgtagacaaaacagtgtgtaaaaagaacttgggacgtctcacgcggttataccttaaagcagaacaagagaggcaacataattatctgaaggatggtccatatatttcaccagaagaagctgtagctatctacacgacaactgttcattggctggaatcacgacgctttgctccaattcctttcccgccactttcatacaaacatgatacaaaacttcttattttggctttagaaagattaaaagaagcttacagtgtgaaatccaggctgaatcagagtcaaagagaagaactgggtctcatagaacaagcatatgataatcctcatgaagctctatcgaggattaagcgtcatcttttaactcaaagggcgtttaaagaagtcggcattgaatttatggatttatacagtcacttgattcctgtgtatgatgtcgagcctttggagaaaattacggatgcttatttggatcaatacctgtggtatgaagcggacaaacgaaggttgttccctccgtggataaaaccttccgataccgaaccccctccacttttggtttacaagtggtgtcaaggaatcaataacctacaagatgtttgggacgtgaacgaaggggaatgcaatgttttgcttgaatcgaagttcgagaagctgtacgaaaagattgatttaacgctgctcaatcgtttgctacgtctgattgtcgaccacaacatcgccgattacatgacggcgaagaacaacgtcgtcataaactacaaagatatgaatcacacgaacagttatggcatcataaggggcttgcagttcgcgtcctttatcactcagtattacgggctggttttagaccttctgatcttgggcttgcagagagccagtgagatggccggaccgccgcagatgccgaatgatttcctcacattccaggacgtgcagaccgagacttgtcatcctataaggctctactgcagatacgttgataggattcatatgttcttccgctttacggccgaggaagctaaagatcttatccagagatatttgacggaacatccagatccgaataacgagaacatcgtggggtacaataataaaaagtgctggccgagggacgcgaggatgaggctgatgaagcacgacgttaatttaggtcgagcggtattttgggacataaaaaatcgtttaccgcggtcagtaaccaccatacagtgggagaacagtttcgtcagcgtttattccaaggataaccccaacttgcttttcaatatgtgtggcttcgaatgtcgcattctgccgaaatgtcgcacccaacatgaggaattcactcacagagatggagtttggaacttgcagcatgaaggaagcaaggagaggacggcgcagtgcttcttacgagtggacgacgaatcgatgagtagattccacaatagggtgcgacaaatcttgatggcttcaggatcgacgacattcaccaaaatcgtgaacaaatggaacacagctttgatcggtttaatgacttacttcagggaggcggtggtgaacactcaagaactcctcgacttgctggtgaagtgcgagaacaaaattcagacccgtatcaagatcgggctgaactcgaaaatgcccagtcgtttcccgcccgtcgtattctacactcccaaggaattgggaggcttgggtatgttgtctatgggtcacgttctaataccacaatccgacttgagatggtctaaacaaacagatgtcggtattactcatttccgttctggtatgagtcatgacgaggaccagttaattcccaatttatacagatacattcagccgtgggaatcggaatttattgattcccaaagagtgtgggctgagtatgctctaaagagacaggaagcgaacgcgcaaaatagacgtttgactctggaagacttggaggattcatgggatagaggtataccgaggattaacactttgttccaaaaggatagacacactttggcatatgataaaggctggagaataagaactgaatttaaacagtaccaggtattgaaacagaatcccttctggtggacccatcaaagacatgatggtaaactgtggaatttgaacaattacagaacagacatgatacaagcccttggtggtgttgaaggtatcctagaacacactttattcaaaggcacatatttcccaacatgggaaggtcttttctgggaaaaggcatctggtttcgaagaatcaatgaagtacaagaaattgaccaacgcccagagatccggtttgaatcaaatccctaaccgtcgattcacgctctggtggtcaccgaccatcaacagagccaacgtttacgttggtttccaggtacaacttgatctgactggtattttcatgcatggtaaaattcctacgctgaaaatttctctgattcaaatcttcagagctcacttgtggcaaaaggtccacgaatccatcgttatggatctttgtcaggtgtttgatcaagaactggacgctttggaaattgaaacggtgcagaaggaaactatccaccctaggaagtcgtacaagatgaattcgtcttgtgcggatatattactgttttcggcttataagtggaatgtttctagaccttccctgttagctgataccaaggataccatggataacacaactacgcagaagtattggattgatgtacaactgagatggggcgattatgactctcatgacgtcgaacgttatgctagggccaaatttttggattatactactgacaatatgtctatttacccctctcctacgggagttttgattgccattgacttagcatacaatttacatagtgcgtacggtaactggttcccaggctgtaaaccattaattcaacaggctatggccaaaataatgaaggcaaaccctgctctttatgtgttaagagagcgtatccgtaaagctctgcaactttactccagcgaacctaccgaaccatatttgtccagtcaaaactatggagaacttttctcaaatcaaattatttggtttgtcgacgataccaacgtatacagagtcacgattcataagacgttcgaaggcaatctcaccaccaagcccattaacggcgccatcttcattttcaatccaagaacgggacagttgttcttgaagatcattcacacttcggtctgggctggccaaaaacggttgggacaactggccaaatggaaaactgccgaagaagttgcagctttgatcagatcactgcccgtcgaagaacaaccgaaacaaattatcgtgacgaggaaaggcatgttggatcctttggaagtgcatctgctcgatttccccaacatcgtcatcaagggttcggaattacagttgccgttccaggcttgtctgaagatcgagaagttcggcgatttgatcctgaaggctaccgaacctcagatggttttattcaatctttacgacgactggttaaagactatttcgtcatacacggcattctccagattgattttgattctgagagctctgcacgttaacaccgaaaggaccaaggttatattgaagcctgataaaacaaccatcaccgagccgcatcatatttggcctacactgtcagatgacgaatggatcaaagttgaagttcaacttaaggatcttatattggcggattatggaaagaagaacaacgttaacgtagcgtctttgacacagtcagagattcgtgatataattctcggtatggagatcagtgctccgtccgctcaaagacagcaaatcgccgagatcgaaaaacaaaccaaagaacagtcgcaactcacagctactacaactaggacggtcaacaaacacggcgatgagatcattaccagtaccaccagcaattatgaaacgcaaacgttcagttccaaaacagaatggagagttagagctatatcagcgactaatttacatttacgtactaatcatatttatgtcagttctgatgatatcaaggagactggttatacttatatccttcccaagaatgtattaaagaagtttgttaccatatcagatttgagagcacaaatttgtgcctttttgtatggtgtcagtccgcccgacaatccccaagtcaaggaattgcgttgtttggttttgcctccgcagtggggcacccatcaaaccgttcacctaccaaacacgccaccgaatcatccgttcttaaaagacatggaacctttaggctggattcacacccaacaaactaatgaccgacgatccggcctgggatggcgagaaaacgattattattacttgctcatttacaccaggttcgtgttccctaacagcctataaactgacaccttctggcttcgaatggggcaaacagaataccgataaaggaaataatccaaaaggttatctacccagccactatgagaaagtccagatgttactctcggacagattcaccggattctttatggttccatcgcagggcccttggaattacaacttcatgggtgttagacacgaccccagtatgaagtacgagcttcagctggccaatcccaaggaattctaccacgaggtgcatagaccagcccatttcctcaatttctcctctttggaggatgccgatggggctggcgcagatggtgaaaactcctttgcataaaatgtcttttattttgcatttttcttacaaattattgttcccggtaaaacaaatgttgtatatattaggttaaataaaactttttattttattttttaagtgaataaaataaatggaaataaaaaa

SEQ ID NO: 351 - DNA, 1510 bp, Rhynchophorus ferrugineus
ttttttttttttggccgctatttttttgcccgatatatcaaaatttttttagccaatatttttcgatatccaggtttttaaatatcaaaatatcgatattacagggtggccaacacccctaaatgaagtaaatcaaagaagttaaccacaaaatatacagacttcaattttaatgttttgtgaagttgaccttacacgggaagtttttaacaatacaccatatacgtatatacaattgttacggttttgagaacgaattgagaatattagctagaagtcattttatattcgaaaaaatgtccaaggctagtaccagcgctgaggctcaatctcaaatagctcagaaaacttgggaattagctaacaatgtagagatagtgagttccgttgatgaaatatataagtatgatagaaaacaacagcaagatattctgacagcaaaaccatgggataaagatcctcacttttttaaagacattaaaatatctgcactcgcccttctcaagatggtaatgcatgctcgatcaggaggcactcttgaagtaatgggtttgattctgggcaaagtagacgggaacacgatgattgttatggattcattcgcactaccagttgaaggaaccgaaaccagagttaacgcgcaagctcaagcttatgagtatatgagctcctacattgaagcagccaaaatggtcggtaggcaggaaaatgctatcggttggtatcacagtcacccaggatatggttgctggttatcgggaatagatgtcagtactcaaatgttgaatcagaatttccaagaaccctttgttgcaattgtaattgatccagtgagaacaatttcagcgggtaaagtttgtttgggagctttcaggacttacccaaagggctataaaccagcaaatgaggaaccatcagagtatcagactatacctctaaataaaattgaagattttggcgtgcactgtaaacaatattactcactggaagtgtcatatttcaaatctgctcttgatagaaggctgttggattcactctggaataaatactgggttaatacacttagttcatccagtcttttgacaaatgctgattacaccacgggccaaatattcgatctctctgaaaaattagaacaatccgaagcagccataggtaggggaggtttcatagtaggtgctgctgatcccaatgaaaaacgaacagaggacaagctgttaaaggcgacgaaagacagttgcaagacgaccatcgaaattatacatggcctcatggcccagatgatcaaagatagactgttcaatagtgttactcccggtaaaaatgtatctgctgattcggcgaaataatcccgaacttatgtgataattaattaaggtatttgagtgaatttaattatgaaataaaaattagtcaatttgttttaaatattttattcagttataaattgtatggacttttgtaaataaaaatattttggttcacatatgttggacagcgaaaaaaaaaa

SEQ ID NO: 352 - DNA, 872 bp, Rhynchophorus ferrugineus
agcttacattaaacgccgccacatttattaggttaggaagtttgtgtaattgcagttttcgtttttttctatttaaatttgaacactaattatggctgatgcaaaaaaggtacaggaatacaaagataatttaaaagtacgggccgaagaattggtactaaagggctttcccgaaactatagtaaagttgaataacatattagatacacctcactttcgggaccgtgtatttactgatgttcaccaggatctgaatataccaattccggatcctattgtattgaatagtcatactgatctaccaccagccaaaaagacaaaatatgacaatagtatatccaaggatggtaccaaagtatttgttttaccgactggttccgtatcaactaacaaacatctggtggaattggttgaatgtgtcaaacctcatattcgtaaacttgttgaagactcaaatacgatgaaaatgtggatttcctttatgattcctaaaatagaagatggaaataattttggagtatcaatccaagaagacactctggctgaagtacagtcagtagagtccgaagctgcagctttctttgatcaaatatctaggtattttatttcaagaggaaagttgatttcaaaagtggcaaagtatccacatattgacgactatcgtagagcagtgcaagagctcgatgaaaaggaatatcttagcctttggttagtaatgtcagaaatacgtaaccggtattgcgcattgcatgatattgttctgaagaatctggataaaataaagaaaccgcgctctgctaacgtaacagaatctttgtattaagtagagtatttttcaaataaattactaaaccaatctcggaagagcgtcg

SEQ ID NO: 353 - DNA, 887 bp, Rhynchophorus ferrugineus
gtcggaacttttatatatgtctataaagtcctatttattttctatacagaatcaaaaaattgcaaatcatttaccacagaatacaagaagtcttatatccctagatattgtgttaaataattttttactttaataaacatatattatatgtatatagtattcacaatattatattaagttatggtgtttggagaaattatagagccctcaactagggctttagtaatagaagatgaacatttggaaaatattccgttatatataggacctatttatcaatgggaaggccaagcccaggttcctgatgatttagaaactcttattgttgttgaaagcaagagagctatttatatagcttcatttctaattaaggaaaaacaacctgtatgttcaatacgtaatgaaggggtttctatctataaagttgataaaaattacattgtattgtttttaaatcaaacgaaaagtttaatattgggagagatagcagaaattttatcaccttggttaaagaaggcaaaatcaatacaagccataacaacagagccaataagtagtttgaaacctacagaaatgtataaggatatggttacaataacaaagtatttaacaaattatgagaccgtacctcttaattttggttcaaaattagatatacccaacttagtgcaaggccttggagcttcaattttatcatactgtattcaccacaatataaaagctgttttatggattgtatatactgatcatatgccccctgattctgaaaatacctcagagttaattaaatatttttatatgttgcattttgattttgtggtagattttaagaactcatcttctgataataatttgtatatgtaaataaaatataaagaaaaaaaaaa

SEQ ID NO: 354 - DNA, 1074 bp, Rhynchophorus ferrugineus
aagaatctttgtttgtaacctttcttttagcaaaaattttgttgagttagaaaagtcatcattaagaatggtgggatgttttaatattgaaacaggccttaaattagctggctttacgttagtaatacccagtattagtatcgggaatgtccctcaactaacagtagatttgcttatagcgtctctaaatttggataagtcaatcagtgtttggcatcctgctatagtaaattcggtaggttcagatccatataacattcaatctgcagcagtttcaacagcctgtcaactatattacaacgatggccttaaattagctgttctacaatttagaacaacctttgataggagacgaattggaatattcttgtcagatttgcttaaagctattgtgaagctagaatttaaaaaaattgtgatactttcttcactatttgattatgagctaactaacatcagagataaggaaaatctgttttatgccaccagtggtcaaattagtgaagatataatcaaaagtgttaaagctaaagttctagaaaaggatcagaatggatatttgttaatatcaggtgctggtttagctaggaagttgtacaatatgcttgaaaacaaagtggaatgtacattattggttaaatatgtatctgaaggggacaacacatcagattcaaaggtttttttgaagcagttacttcagtttattccaattgattcaagcaaactaaaaataacaatacccccatcttggagttatataaatggcggtcctccatcactaggtatattttaataaaaaccagtaaataataagctttaattaatatatttcccaaaatactaaaataacaacttaaaacctaggaataagtaggtgatcattgtcaacacaaaaaatattacagcaaacctaaaaactattttgttagaagattaactaattaatttgtttgtaacttacaaaagaactatcaggaacacaaatttaaaatcattgttataatcagtatattctatcattattgtattgtcatttactgtgacaaaatgtttgacaagttttgcttacctgta

SEQ ID NO: 355 - DNA, 602 bp, Rhynchophorus ferrugineus
ctttacattttttttaaattttaaataattggttccttatattaataagttaataagtaatatatgattaataatggatttagctgattctattactagttcagaaattaataatacgtcagtagccagtaggaattttgcagcactgcttgaaaataatcgcactgaattcgtcatttcgaagtttgagaattatttaatatttataataagtcaatatgccaaagttggaaatttatacgctgtgacactggaacaactggaaaatggtgtacttaatcctagtcccgtttatgatataaggcatttatttggagatgacagtattgaaattgaagcaggagtgagatttgttgttggacaacttaatatcagaacgcccatagtaatgtgtttaacactgataaattatgaattagaaactctgagactcgttgttgaagctttgaagatgcatttttcaattcaagagaatggtaatctaaatagtgaataaatgtcattgtttgaaaaggatgctttattgtttggatataataggtttaaatgattatttctatgtaattataaaatttaagatttatatttttgttattagtgag

SEQ ID NO: 356 - DNA, 1367 bp, Rhynchophorus ferrugineus
ccaaagcaaaaaacagtacatagattcatagaaaaaatcattattaaaatgcatagattatatatcacaaaaaattttggcatatacatataaacaatgtctctgataaagaaaactcgaattagtgagaattattttgggcaagttgttataggacctccaggtagtggtaaaacaacttactgtgaaaaggtgtatactttttataaggataaattaaatcgtaaagttgaggttgtaaatttagatcccgcaaatgaaaacatgagttataaaccaaatattgatattatgcaacttataacagtagaagatgttatgcagaattgtcatttaggtccaaatggcgctttgatgtactgcatggagtatctggaagaaaactttgactggttacttaatcagctaatgcatattaaagatagctatataatatttgatatgccaggtcaagtagaactttatactcaccatgaatcaataaaaaaaatattccttaaactggaaaaattaaattaccacttatgtgcagtccatttagttgattcacattattgttctgacccaccaaagtttatatcaacattacttctttctttatcaactatgatgcaaattgccttgcctcacgtaaatgtattaagtaaggcagatctgctaaaaaaacattcatttaagttagattttggtttagacttttacaccgatgtcttaaacctggagtatctattagaattactagatgatggaccatttacaaataaatacaaaaagttgaatgcagccatagttggccttatacaggactatagcctagtgtcgtttattccattaaatgtgcattcaggtaaaagtttattagaattgaaaaatgccattgataaggccaatggatatatttatggtagtggagaggaaagaagtatacaagctttattatcttgtgcagttggagctagaaccgaaagtgaaagatttgacgttgattacttataaatttatttgttacatttatggaaaataaacaattaaaatagcttattattacattcttttaaccatgatattactttcctgagggttttgccttttgtttttctaattgtgcccttaattgcttattgaagtcgtcttcaatattatcatcttcccagttatcctcccatacactaatgtcttgatcgtccttttctttccctgtccaatcttcgacagggaattcctcgaattcatcatcttcttctagtacacccaaatctaattttggtttctcagccattctgtgttttaacacaagatatatttttacggttattcagtgaaaaacggtatttgaaaagtcactctaaaccgaataattattgacg

SEQ ID NO: 357 - DNA, 1070 bp, Rhynchophorus ferrugineus
attgaggttatcttcgtaaataaaaactttaagtttttggatgtttttctatgttctggatgcatcaagcatagaatatactggttgttttatgttctaggtgcttgttatagaaaaattataccctgattgttctatagtgcttgcgacgcttggcataaaataaaatattgtattataaatatttggattcagtaatacataatgcgttatgcacaattagttattggaccagcaggcagtggaaagtcaacttattgtagtgctctagcacaatatggagttgataccaaaagaaatatagacgttgtaaatttagatccagcagctgaacattttacttatgagccacttgtggatattagagagttaattcaagttcaagatacaatggaagatgaagaattacattttggtcctaatgggggactggttttttgcattgaatatttattggagaactctgattggttacatgaaagattaggtgaacaagaagatgattatattctatttgattgtcctggacaaattgaattatatacacatttaactgctgtcaagaaattagttaaacaattacaagattggaattttaatgtctgttcagtatttttagttgatgtgcagtttatgactgatggatcaaagtttttatctggaacgatggctgctctaagtgttatggtgaatcttgaattacctcatgttaatatactttccaaaatggatctgttaagtaaaagtgctagaaaaagattagaaagatttcttgaaccagattgccatgcaatattgggggatatagaattaaatggaatttcagcatttaatgaaaagcataaaaaattaactgaaactataggaagaataattgaagattattcactggttagatttatacctttaaatctgcgaaattatgaaaatataggagatatccttataacaattgataatgtaatacaatttggtgaagatcaggatgttaaaacaaaagattttgaagaagaggatcctgaaaatcctgatatagaacttacgaataattagtttattaaaataaagac

SEQ ID NO: 358 - DNA, 1326 bp, Rhynchophorus ferrugineus
cgccacaactagtcgaggtttaaaagcaaacgtcacaactaacctttttgttttcataaaaattctcttgtgcagtgatttgaatttttaaaattatgttaaaataaaagtatttttatacattatctttttaaaaatgttaaatcaggttaatgtagaggcggtatattcggccacatatgtggagaactatttggactgtgtggaaaacttcccagatgaacttcaacgtctcatatcgcgtatgcgagaactggatgtttactacctagcccgtgtgagagaggtaactaatcaacagaggaatattaaaaactgcgccaacagtgcacagaaagataaaatctttaagaggatgcaacaagctttaatagccgcccaagaactaggtgacgagaaaatgagtcttctccaaagcatttctgataagattgaaatgaagactaggttattagatcaagactttaaaaatttagattttggtaaggatgaaagcacaacaacagatagcaaggatcttcaaactcctgtaattagtacaagtaataacaattcaacaaataataatgaaaggccaatcaaaagggcgaggagaggaaggaatgacacttacacggcgatcgaggtcagtcagaacgacttgacggtccctgagcataccttgagaagtcaggccccagtgacaggtactagttcaagtggatcggtacagaaaaagaccagtacaggtaaaaagaagaaacgtaaatcgcgacagattcaaacccagaaagaagattcccctccaccagaggagcaagctatcgacccagatgaaccaacatactgtctctgcgatcagatttcctttggggaaatgatcatgtgcgacaatgacctatgtccgatcgaatggttccacttttcgtgcgtaacgctcaccaccaagcctaaaggcaaatggtactgcccgaaatgtcgtggcgacaggcccaacatcatgaaaccgaaggctctattcttgagggaattgcaaaagtataacaaagaaaaggaggaaaagacataatgattcctgttctgtttttgttttggttttaaattccccacttatatatttataatgctggcttgaacgtaagtttttagtaaaaccacactgtattttatttaccaataacagtctctctaagagagtctaatgcattagatgcgtttataatttgatgataaattttaattctggttcaatatatttttgtattatcaataatccagttttacaaattagttcccatataacaaaaattatacaacttcctgtaatcgttaaaaattatatacgtg

SEQ ID NO: 359 - DNA, 1274 bp, Rhynchophorus ferrugineus
gttctaagcctattatagctcaagaagaaaaaaacaaaaacataacctatagtagtcaatcaaagtttgaatgacaaacacttattgagtttttcgtgttattaaatctctgtgattatcttctcatacacctaaaatggcatcaggtttatttggttgggacttgctgtataacagtgttgaaaaagatattaaaaacgatcaagatattttggtatgcctcactcatttagtactgatatcaaagggatttaaatgtattggattgggagaaagtaaacatattgatggatctgagaccaagactgaaagtttacctaaaggatggaatgaagagtatgctataagatacatttttcaaggcaaattgtataacttgaagggcactaatttagatgagagtgtgatacttaatctagttcgggtagatgaacgcacagttggttcattacaactaaatgcaagacaagtgttgtcgaggaaaggaacactgccagatatgattccagaaagtgaagatatagtagcccagattcaaagtgaattaatcgatagagttgttatttcaacaaggacacaggataatgcaacccaaaccccagctgtcgataggggatctggaattaggtctacagatccatttcctatgtttccttttgccatgcctgatataggcaggtcgttggtacagccatatggtcgttcagatttggatccctttggttttgagccgagaaacccaggacgtatcggcgttctaccaggaggtggaggaatgatttttaatccaccaaggccttcttttccaccaggtaatttaggcgtaccgccaggatcacttccaccaggagctcgatttgacccattcagacctccagatggtggtccgaatcctagagctcctagaaggcctgataatgatgaatttcctccacctggttatgatgatatgtttatgtaaatatctacatgttataatttaagcactaaataaatgtaatgtcgctaaacaaaatccccagtacctgtttactccttttttcccacttattccgtctttttctgtattttgcaagaactctggttagtttaggtccaagcctgtattcaataactgactgtgataaacttagcaagaagaattctaggggtgattcggtggtctccacttttgttgcaatagttttttgtgcaacctgtattctttcaggaggcctgttagaatatttaatcatcatttcatcaaaatcgaatcaaaatatcaaatcatttca

SEQ ID NO: 360 - DNA, 4798 bp, Rhynchophorus ferrugineus
  misc_feature (4567)..(4586): n is a, c, g, t or u
ccttgtgtataccagtagtggtaaatgagatttcgtttgggcggtaaagaatttcgaaaactctatcgctggctcgctcaccgtgatatcgggaaaacgggacctgttgcttcgtgtgataaaaataagaacgttccaacccgtcgttatgtggtgttttttaattagtgtctagaagtgttaaagcacgcccggaacaatatttacgatgggattaccttttacgaaagatgcctcagaagatgtggaggaacgaccggagcctgggtctaaacttcatggacggcaggctagtattagacagagcactattagagctaaggctaaacaagctatgcccgaccccggagagttggagatgagatttatgaaagttctggcttctatggaccttcctcccgataaagccaagctgctgaaaagctatgactcggagaagaaatgggatattatctgtgatcaggagatggtacacgctaaggacccaccgtcgcattatttgaataaattgaggacgtatttagatccgaaggcgtctagaagtcacaggaaaagaaaaatggttgtagaatctacttctacacaagtcctaagagatttagagatatcattaaggaccaatcacatagaatgggtgcgggagttcctcaacgaagagaacaacggtttggacgtgctcatcgattatctgagctttcgtctgggcatgatgcgacacgaacagaggatagccgaatcgcggacgacgtcagaagagaaattgggctcgacgacggcgacgacgttgaattcctccactttcgagaagagtctcgataagagtttcgaaaggacgaacggttacattcgaatgccgctggacatcagcgacagtcccagtttgaaacgaagatcgaaacacgtagcgaaactgaacatgggcgaatcgaaagacgatattcacgtttgcatcatgtgcttgagagcaataatgaataataaatacggttttaacatggtaatacaacatcacgaagccataaactgcatatcacttagtttaatacacaaaagtctcaggacgaaagccttagttttagaattattagcggcgatttgcttggtgaaaggaggacacgaaataatactatccgccttcgacagctttaaggaagtttgccatgaagttcacaggtttcagactctcatggattttttcctgaattacgaggtgttccacatagagttcatggtcgcctgtatgcaattcgttaacatcatagtgcactcggtcgaagacatgaacttcagagtgcacttacaatacgagttcactgccttaggtttagatagttacttagaaaaattgaggttcacggagagcgaggaattacaagtgcaaatttccgcttatctggataatgtattcgatgtggctgctttgatggaggacagcgaaaccaagacggctgctctcgagaaagtcagcgagttagaaggaatagttgatcagtggcacgaaaggttgtacgatgtagaacaaagggctttagagaaaattggaatgttggaagcagatctgatacaaattaggcaagaacgagacgaactgctcgaattcaagaagagggcggacgaggaggtttccacgctgaggcgggtagttcaacatcacgaagaagagtcgaaaaacagacagtcgatattcgagagtaaaatcgccgagctggagaacaacaaaaccctaccaaaaagtacgccgagccctactacagataatttccccccaccacctcccccgccaagtatacccgctcctcctccttgcccgccggccgcgcccgcagctccgccaccaccgtgtccgcctccacctcccaaagcaccagatatgcccggtataccaggagcacccatccccccaccaccagccggcttgatgcaagcgccggaaggagcaatgaccattaaaagaaaagtgcaaaccaagtacaaattacccacgatcaattggatagcgttaaaaccgaaccaagtaaggggtacgatctttaacgagctggacgatgacaaattgcacagttacatcgactttagcgagttcgaggagaaattcaagattggtaacgcgggccttttggcgaacggaacttgcgatactgacggattgcaaactttccccagtaaaaggtttaagaaaccagaaaacgtgaccttattggaacatacaaggctgagaaatatcgcgatatcgagaagaaaattggagatgcccccggagaaggtcatcaacgccatcaacatgctagatctgaaacaactatcgttggagaacgtcgaactgctccagaggatggtgcccaccgaccaggagaccaaagcttacaaggagtacatcgtagagaagaagaatgtcaatctattgacggaagaagacaagtttttgcttcagttaacgaaagtcgacaggatatctgcgaaattatcgataatgagctatatcgggaacttttttgataacttacacctgattcaaccgcaaatccatgcaattatttcgggatcaaactcggtcaaaaattcgaggaagctgcgttccgtgttggaaatcattcttgcctttggtaactacctcaacagcgcaaaaagaggaccggcctatggtttcaaactgcaatctcttgattctctacttgataccaaatcgacggacaagagactgtgcctgctccattacatcgtagctaccatacggcagaagttccctgaattgcttagttttgattctgaactgaattacatcgaaaaggcagctgttgtttcactagaaaatatttctactgacgttcatgagctggaaaagggcatggaagctgttaggaaggaggcggaaattcgcggcagaggcaatcacagcttggttgtgagggacttcctggccaattccgaggacaagttccgaaggctgaagggcgacgccaaaatggctcaagaggcctttagggaatgcgtcgaatatttcgctgaatctccgagaacaactgatgcgaatacattcttctctttattagttagatttgtaaaagcttttaaatctgcagaccaagaaaatgaacagagaagaaggttggaaatagcagctcaaaatgcaaataacaaagccaacgaagatgtagcaaagaaaaacaaaattaaccagaagaagcagcagttcggttcgcaggacgccgtcataaacgaactaaagacaaaaacaagactggtccaggagaaaaagctcctccagcaggacgaggtgtacaacggcgcgctcgaggacatcctcttgggtctgaaaagcgagccctatcgcagagcggacgcggtgaggaggagtcagcgaaggaagatcgacaacaatcggctgtcgaaaacgctggaggagctggagttataggaacgttatgacaatacaacccctcgacactatcaaagctttataggtatatgaataatataatttgtttttgttttagttgaaaatcgtgtaatgtatctgtttacgtttatttatatatgaaattccacttttattttgttaaatattaatcttacgtgagcgtccgagcttaattttatgatatagaatgacaaaatcgaaaaaatcgtactgattgtgatactattagaaacattggatgtttttttgttgtgttgactaagcaatatatcaagcattatatgcggaaaagccttataaaagactagcggtgccttttttgatgtattttctattgtttataaaacgaaaatgaaaaaaaactcgaatatatgatattagtttcatccagacattttattacaacagcaattagatgcttttagctttaaactgctttagccattatataagtatagtacttaccccaaggcatagatgggaacaattaaatcaaaaacaaaaagtcaaatatatatttagttctaagacagacaacataacaatatctaacagtatcaatagaaggctgtttaaactgtcaacttacggtgataatgacatatgacataacccatagaaaggatattctgtagcactggtttacctagaaatacatcatccctaaagatttcttgactagagcccaaccaaattatatccaaattattggctttgctgcttttcaaaaagtttttggtttctaggtttatcgttttcagtcgatctttctttgcttgggacatcttcgactgttacttccatgagcttcttgattttttaaatctttctactatcatacttttccagccacaatagttgaaactttaggtcttgtgttccacaaaggaatacaaaattataaataacataagttaataatgttttagttagtgatggataatttgtttttgcccgtcaatgcctttgggatgctactatatcagtgtttattattctgtaaatatataaatatttcattatacaataatactcccttttttttatcaatatataactcaattatttatttagcccatgaaattatgagagtaattgtgatgttgtaaataaattgtaaataaacttgcaatcgagcctattccggannnnnnnnnnnnnnnnnnnngttacgtgttgggtttccagaatagacttgtaacttctgtactgatttctattgattctaagaggaaatattgtctctataagattcctatagagatgggcacaatttaaattgttttctactaagtaacatgtaatatattgtaaaaccatattttcagactttttcagaatattctactaaattcgttaataaaatcaatagaaaattaa

SEQ ID NO: 361 - DNA, 981 bp, Rhynchophorus ferrugineus
gtcacattattttaggttattcgtttttgtcagtcattgtctttatcaattttaaagcaatttataactaaatatatatataaatcatgggctctgtaaaaactgtaacggatgaagcaaacttccaatcggaattagcaaatgctggtacgaaacttgttgttgttgactttactgctacatggtgtgggccttgccagagaatggctccggttttccagcaatatgcaactaagtatcctaaggctgtatttctaaaagttgatgtagaccaatgtcaagaaactgcagctagccaaggtgtatcagccatgcctacatttatcttctataaaaacaaggccaaaattgacagactacagggtgcagatccaacaggtttagaagctaaaattcaacagttttatggatcagaagatggagaggactctgaaggggttgctggtcatatggatctttcaccttttattactaaagctcaatgtgaatgtttaaatgaaagtgatgaacatccgttagctcatgctttgaccagttcaggaggatatttggaatcagattgtgatgatcaactaattatttcaattgcatttaatcaatctgtcaaaattcatagtttgaaaattaaggcaccttcagataaagggccaaaaaatattaaaatttttataaatcaaccacgaacattagattttgatcttgctgataattatacatgtgtacaagccttacaactgacacctgaagatttagaaggaaatccagtaaatttaagatatgtaaagtaccaaaatgttcaaaatattcagttctttattgaagacaatcaacatggtggtgatgtaacacaagtagatcaattaactataataggatcaccaattaatacaactaatatgggagattttaaaagagtaacaggaacaaaaggagaaagccattaacatttattctatctgatcagctgtatcggatttttca

SEQ ID NO: 362 - DNA, 757 bp, Rhynchophorus ferrugineus
gctaagttcaattttgttaaacattaatttgaggaaattttctgaaaaaagttatttacttataatttaaagtattatatggcatctcgtggcaaatgttgtggagatccgaatcatcaacatgatgatccagaaagaggtattcaatatagtttgtacaccaaaattaatactaacgacttagagtgtttaaatgaatcaactgagggttctggaaaattagtttttaagccatgggaggatcgattaaatagggaatcttttgtagaatcagacgctgacgaggaattattatttaacataccattcactggttctgtaaaactgaaaggtataattgtaataggtgatagttcagattctcatccatcaaaaatgaggctgtttaaaaatagagaatcaatgacatttgatgatgtagcattaattccagatcaagaatttgaaatgcaaaaggacacagaaggtcttttggaatatgttacaaaggtggttacattcaatcatgtcactcatttaacaatccacttccctaagaactttggtgaagaacacactagaatatactatattggattgaaaggtgaatatgcagaagtacacagacatggtgttactatttgcaattatgagttaagaccaaatatgtcagatcataaaaatcccttagaagataacataaatcacccagttgcttaatataatttttaagattgctaatactatttaatattactgataataaacatacgttgtc

SEQ ID NO: 363 - DNA, 4353 bp, Rhynchophorus ferrugineus
actgacagcgaagtagcgtgcgaggaggcagcccgtctcactgccgaacagcaagaggaggatgaggacggcttgtcatactgcgattatcatgacctgccgccgccacccgatggtggctacggctgggtcattgtgttcgcctccttcatgtgcaacatgatcgtagatggtatagcgtacacatttggagtcttcctttcacccatggtcgactactatggtgaaactaagggaaaaacagcctgggttggttcattgttatccggcatgtacttaagtgctggtcctctagtcagtgcccttaccaacaaattcggttgtcgtactgtttgtgtagcggggagtattatctcaaccatggcctttgtactcagcatctttagccccacggtcaactggctgatgctaacttatggcttcataggcggactgggtttcggtcttatctacttgccagctgtggtctgtgtaggttactattttgaaaccaaacgttccttagccacaggcattgctgtgtgtggttcaggagtgggcacctttgcttttgctcccctcgcagatatggtatttggtgctctcatgcgccctctcacctacccaaaagaatcaggcgagaaaccgctactgcaacgcatggccgaggaaagacgcattcagatggagaggggaagtattggcggttcatattttctagtacaattgcctgatggaacaatggaaaaaagaatgaaacagccacttaatattgatccgggtgttcattctagtttgaatctagaccagctggcaccaggaacacctatcacacctataccaacggttcctacactgcccaccattgctgaagttaaaataaccgaacaaagtggtagttctggtagtccaagtcctggagaaagtacagttgaaatcaaacacccgcgtttaaatgaactaaaaaacaatgtcgaagggaaagatccaaaaatgccacgaaacgccagtcagccagctttctcttcccatacacagggtttgcccaaaaatggatccgttccaacctttgataggataagaaaaacgtccgtaagtgagcgcttcaaacctaccttggatccaatcaaatcatcctccagagggaaaattgcttcgaacagtgatatgaggagattgaggaatacatctactggatcattcattagtcgaaataataatagtgaggtagatgtcgaaagcttagcctatacgtccaaattatcattagctcgtgaaaagagcaacatggtacgaccgatgtcaagaaaagatattttctactctggatctatcactaaccttcaagagtttcatcaatctcaaaaatctctgactaattaccgacaaagcattatgagtatacccaaaattaaacaactggaggaagaaggatctcccgaagatatttgcccatgccttgtcctgcccgacagtttcaaatcggcactgtcccagatgttggatgtcagtcttttgaagaaccccgtgtttatgctcatagccgtttcaaacttatttggaatggctggattgtatgtgccatttgtttaccttgtggattgtgctaaaaacgacatgattcccgctgcaaaagcatcctttttactctcaattattggcattacaaacacttttggtcgtgtagcctgcggctattttgctgattttccccaagttaacgccctactcgttaataatatttgcttggtaatttcaacaatcgctgtggccgcaacgccattttgtcatacgtaccacgcttacgttattatgtcaattgcttttggaattgctgtatctggctatatttccttgacttccatcatactcgtcgatcttttaggactagataagcttaccaatgcttttggtctcttaattctattccgtggcgctgccgccattgttggatctccgatggctggagccctttatgacgcaactcaatcctatgccgttccattttatgtcgctggcgggctatttgctctttcagctgtcaccagttttatggcaggatgtatgaaaagattcactggcgatgatgaacagccccaaggagagggtgatgcattaactccgattgatgaggatgatgaagaagatgaacctattaccatgggtcagggcaacaagccactgcccaagataattgagaccgcttcaagtccaatggaaaaggagattaaacagatcgagtcagttttgtaaagtagatgtgatgattgggtatgttgtggacaaagtggtttaggtcgtattttgtcttatgcaaaaccaatctttgtaacattgtgataaaaatatagcgcctgtttattgaacgtcgtcagattcagttgagttttcgcccatgtttccaatatggaaaatctttaaaatcaaacatacctcatcatcaataaacaggtgcactaaatctagttgtatttgcataacacataataagtaacaattaaatcaacataacatttgtggtagatattgttaatgtaaacgtgtagctggggaatactgattgattggtttaaacaattttttacgctaccttaactaataagcttggtaatatttaattatatggatacgcgataaaaccgacgaattccgatatttccaacttttcttttttaaactgctctaattatattgttctattaaaaatacaattttaaatctattaggatggggtaaggtcttactattttttctatatctttgtaataacagtaatatccatagtgtcgtgtaatttttaatttattaaattgggactaaatacataccaaatggatgataatttcaatagtaacaaacatatccgggcatactggatgacatgctaaaaacggtgaagactcatatggttacttcattaatatctagtagtcatgtatgttatttagatcagtattttttaatatattgatgagtatcttagcatgaaagggctatagagctgtttatatagataccctcgaataaattgataagcaaggagttatttaattaaagtcataaactaatacacgtaagccctttttcttggatacttcatatacttggtattcaatataagatataaattaaatggtgtaattttgttgttgcgtgtcacgttgtgttaatttgtttacgttgatttgtaggtgtcctgttcaaccaacaaaaatatagaagctgttagttgatcaaggtattaaaaaagcgtaagaactaggcctatccccatctttaaactgtttttaattatattattacttaggataattcgcaaggcttacttaaaacaatttaaccgttttttacttaattattaagactgtaagatacaccataaaagtacgtttcaccagtattaaaagatttcgctttttagggcatttgtcgttctttcctttttgtttttgaagagaattgtaattcgtttgaaattgtaaatcaaacaaattaatgagactgatttttgtacattgtaacgaagaattgtatgtttctacaaatcctattacacttaagttagcgagaagaacgaactaaacaatttcaaatgaaatacaattcaaaatatgttttatataaatttaatattttaacgcgtaaaaatataatttcaaactatgttgaaaggttatacaagaacgtgcaaaacaataactcttcaatgtacagtttcttcataagtgcccacataaaaaacgctacccagacttattttgaatattttatatttctttattggcctctgaaaacgttttattattccagttcggctattcctgttattacaataaattcataaaaatataattatatgtaaatcaaagagatctgtatagatgaataaattaacttgtataatgacacttttactaatataagtaacaaagaaaaagcataaggtgtacatacaataataaattattagtttatttttaattgtttagctttaaaccaaactgtaagattttgtatgaattgtcttctggaaatagtaaaatattggtaaaatataaacttttagagagcgtttagtagtagcattgtgcacaagatgagctgtgtaaatacgaagttacacaagagaatcgtcccaggcgttttatttaaacattttgctgtgtttaatcgctatttcaaatgtaaattagaataggttttagtacttaggtctcgtttaatacatgctcaggacagttacaagtcgtaaatgaataaattataaataatggtgtagccttatgatagacagtactaggtacctgtgcacttaaaaatgaaatttaattcttaaaatacccaataaagttgttatgatctcacaaaaaaaaa

SEQ ID NO: 364 - DNA, 3154 bp, Rhynchophorus ferrugineus
cttaaaatcaaatcatcctttatacataacatttgtgtagtatcattctgtaggttaagattttctttataaaatttatatatatacgcgtatatagtgacagttttatagttgtatgcgtttttcatgaatcaaaagaaatattaaatagaccaatgaatattagtggtgtttatagtttttattgtgacaatgcgattgaagtttttgaaaaaaaaagttttgttttaaagaatcgttgctactttcggcggtttatatcagccacgtatggaaaaacagacgaagcctgctagacattcccggcacctataccttgccatcacacgtatgaaacgacctctgactacacgtcccctagcgtcgttgcgtcgacagttcaccagagacttacaagaatggcccaaactttggacactaacggcccacaaaccgtgcgaaacgacgttaacaaaataagtgacaaaagttgtgacgacaatagtgttacgactgacaacaaacccgtcacgttgtcaaacggtgaagccgcgtgtcaaaatagaagtacacctagcgttaagaaatcgtctaccaaacccgagcgacatggtagcgcgtcgaagaagtacaacatggaactgttccttaatgagaagaatgcaaagaggaaacccaaggtggaagtgaatccgctatacgataacggagagaacgaacaacttctcaatcacgctatcattatgcctaccgaagacaaaccagtattacgtgtacagttcaatcacaaagacagtgactcgtcaattatcaaacaggatccgccatcaccgtcgacctcgtcagacaattccagctcgcagtcgtcttcgtcgagctcgtcctccgagtccctggatatttcagaggcgcgtccgcctgacggcggctggggatgggttgtggtggctgcatccttcgtagtgaacttgattgccgatggcatcaccttcagttttggtgtgatttatgttgaatttttaaattatttcggcgaaaaccgtggtactaccgcctgggttggtggtttgtttatggctatgccattattatctggaccgattgccagttttcttacagaccgatatggttgtagaaaagtaaccgtatttggagctatccttgcttcgataggatttatcatcagctcccaggctaacagcatgattgtgctttgtattacgttcggagttttagcgggattcggtctcagcctatgttatgtagcttcagtagtgatagtggcttattactttgataaaagaagatcattcgctaccggcttagcagtatgtggtagtggaattggaacattcattttcgcaccattgatacagctgttattggacgaatatggctggcgagggacgactttgatactcgcaggattatttttgaatatggtagtttgtggagccctaatgcgcgatttaccttggacatccgaaaaacagaaatcactagctaacgaaagaaagaaaaatagaattttaaaacgaaaaaaacaaccagtatcagctgattctttttcgattagtactggtacttgtacagctagtgtcttgcagcctattatcgaggccaatgaagatcaagagcaagaccgtcagtctattcgactttgtagttcattagttaatttacctacatatataaaagatggtgaaaaaatccctgctgaagtattagagcttttagctagtaataaaaacatctacaatattctcttaaccaattatccgaatcttttagtaccgtcgcgaagcttcagtgattccggtcgattgaacgaagcacatttgtcatcaaaacacgcaaaaactaccacgcagttatcgcctcccgcgcatatatctaaagaagatacttggtggttaaatgggaatctcatgtctccaacgtctcctacacagaaggcaatacctaggaagcatcctgtggaaaaatctctctctgcaagaatgcacagactatcagttacttaccgaggagctatgctgaacttgaaacggcataggcttcgatcaagctcatgtcctgatatctaccggaactcgatgactatgatggcgcaagaaaaggttaaatggtacgcaggactatgggacttttgggatctcttagtggacatgtttgatttttcacacttcgccgattcaaaatacttagtgtttgccctttcgaattttcttttatacacgtggtatgacgttccatatgtctatttgaccgacaacgctatcaagtcgttgggattctcagaaaaggatgcatcattgctaatatccatcattggaattattaacatgcttggcgagattatccttggatgggtaggagatcgatcttgggccaacgccagcatcatttacgccgtttgtatgggactttgtggcggtgttatagccttgatccctttaattcacgattatacgctactctgtctcgtttctggggcattcggattcctgatagctgctaattattccttaacatgcgtgattctagtcgagctaataactctggaccgatttaccaacgcctatggtctgttgctcttggtacagggttttgccaacttaattgggccaccaattggaggttggctatatgacataacaggaacgtaccacctctcattctacttggcaggactgttcatagcgatttccggtttaatgctagtagtgatacccgttactaaacgttataaacgattcgtcaaagagaaaacttcttccgaggcatcaattaaagaatcttcccaaaatgataataataaagatgatttcgtttcgctagaaccaaaaaagaaaggtgagccataacaacattaactgaacaatatacactggctcaagaaactgccatgggcatcaaaagatattgggtaaagttctcttttttactttgctaaagtgcactgatcaatttagtatttaaatagttatttattaatataggaaaatgatcaatatttagaagagtatcaccacgacctttaaaaaaggaattaattaaacatgtcactttcggtgagtttgagagattatatattcagcgattctgtttttcttggtatctcattttgccataatattggaattttttatcgaatatataacagtgatcatga

SEQ ID NO: 365 - DNA, 1226 bp, Rhynchophorus ferrugineus
ggattacgagttgatcccgcagcccattcttcacataaacggcaacaacaagatgcacagaccgcacagcttcgctcattttaccctaccgaagagcttcaaacacgaacccaacggcaatctaccgggcaagactaagtacagtgacgtatccagactggctctgagtcaacccatgcttacccaatcagagattcatcatgacaggcctcatcatcacggaagtttccgaagaccattcgatcgaccggacatcctctatcaagggagcctgatgaatattccctcttatagatctcgtttggacctaaaccatcacgagagcggcatggaactgtacaggaagcatcgtcgaagcggcagcgacgagagcaccaaggtttgcgggttgattccctgttcgcccgagacgaaggacacgttgagggaaatgctcgatttctccttattcaaagatccagtattcatcattttctcgctcagtaacttactgactagcatagggttcaatataccatacgtttatttagtgcctaaagcaaaggatatggggattacgaaggaaatggcgggtatgttgatttctatcatcggcggggctaatacaatcggcagaattattttgggatacatctcggacaagccgtggataaacagacttcaggtatatagttggagccttactctatgtggtacagctactttctttagtgccttttgtaacaccttctattcgctagctgtatacagttcagtatttggtttcaccataggagcctacgttggactcacatctgttatattggtcgacctgttgggcctcgataaactaacaaatgccttcggactactacttctcttccaggggattgcctctttggtgggaccacctattgctggtagtttgtttgacttgacaaattcatatgacccaggattctgtttggctggtataacagtgggtttaagtgggctgattttattccttataccaccaatacaaaggtggcaactcaagagagtcaacagcacgttaaaagaggaagacatatagctactaattttaatttaaacacgatggtataaagtttattatcaccgtaacaaaatgttttattagatcatttaactgtcgctttatttcatggcgatagccagttttaaattatttctacatatccagaacatttatgaataccagctttcgatcaatttgatatcacagc

SEQ ID NO: 366 - DNA, 1066 bp, Rhynchophorus ferrugineus
agcgtggagtttcagtggctcgtcgaaaatcaaatggggcattcctacaactcgacatgaattttaacactgacagaaccaatcgtttgcgatagccgagacgttgaatttggtggagaaattgaagaaaatgatcgaaaacactcgatcttactttaaacgtcgcaacgagagagtgggatcgagtgataacgacagctacaaaacaatgctgcacgcatgtgtgccatagcgtttacaacgtccagttcaccacgcgccgatcacccacaacgtcgagacgccgcgtgcttcccgccatcaattcgtgcgtgtcgcggcttcccacgaacgctcccgatatgtctcatccagtgcccaaacggcgcgacgacgaggaggagagcgaaacggcaccaccgccggacggaggctggggatggatggttgtgtttggttcgtttatgatccacgtcatcactgatggtgttacgtattcttttggcatattttacgacgaatttttggattatttcaatgaaggcaaagcgataacatcatggattttatcgatattggttggtgtaaccttatgttcaggtcccatatcaagttcgctggtcaataaatggggttgcagagcagtaaccatcgcgggggccattctagcctcggtttgcatggttgtatcattctgggcccagaatgtgataacgctctgcatcaccataggtatcggggctggttttggattcggcctcatctacctaccagccatcgtgagcgtcaccatgtactttgagaagaaacgctcgttagctacggggatagccgtgtgcggttccggatttggtaccttcgtattcgccccgatcatctcgaggctgttggccgaatacggctggcggggcagtatcttgataatcggcggcatcgtgttggagtgcatcatcttcggggcactgttccggccgttggagaacgagagcaacaacaacagctccaagaaggagaagataacggtaccgaaacgctgcgatgccaaagtcgacatccacatatcggattacgagttgatcccgcagcc

SEQ ID NO: 367 - DNA, 1591 bp, Rhynchophorus ferrugineus
tagaatgaccattcagtttaataatggcgtcaaatcaggattggtttaacgctaaaattgcgagcttattacaggaagatttacgaatttcaactttaagtgaattaaaggatcatctggcttcactgccacaagaggatgcttccagaatatccaacatactacaactggcattagtttttgattgcttaaacgataataatacggaacaggtagatttagcctgcgatgtattgtcattatgtttaagtaatttaactcttggagagagtactaaccgatatgggaatgctttagaacgagctttaatacacccttattctgcagtgaaacttatggcgcttaaagaaattaaaaggtctcttttaaacgaagaagttatctatgctataagcacaaaaactgagttaataatgaacatcatatcatgtttaaaagatgatgatttggctgtagtttcagaagcatctgctatattgttcacattaggaataacaatacctggtattaacaaaattacttcaagtgaaattttagtttgcctggatagtacaatgcaaacaaatgaaattactcgtttgagaatttttgaggttattataaatatatccactcaaagtgattatagtttcaagaaactcatagatgctaaatacatggaaaaaattatatgtgatcttcaaaatgatgatatcttacttaagatgaacattgtagaaatgttatcagaattagggcaaagtgagcatggttatgtttatctggacaaaagtagatcgttagataaaattatttctatattgactgaagacaatttgactatgcagttgtgtgaaccaggtattttaaaattctttggacatattgcttataaaaggccaatggaagtaatgaaccaatatgatatgttatttaataggctgtttatgcatctttcttgcgatgatatgactatttttggtatatcattagatattataggccacattggtaaaacagctgaaggcaaaatagcattgcaatcaatagataaaattgaaacagccattaagacagtatcttcacgtttaagttccataccgactgatattaaaatacgagctctaagttgccttgaaagtcttctaagagttactgacaataacaatgaaattacctcccttactcacgaatggtactcattcataggtgcaaatcctatggatgttatccttagatatgcaaaaaatccattttctgagcttcgattatctggattgggtattttgaatgcattagcgaatcagacttggggacaagaagcaatcaaaaactctgcaggcttagtagaatttttattggatcgcaacatagaatctataaaagaatgcaaggaatcaaaatatgaaataatcaaattgctgtcacagagcataattttcgatgaaaacaccttagagagacttcagaactttgttaaggaaggaccattttatgttcaagctctaactgaagtagcgattgaaggaaattaaattttaagtgatcttttaagaaaaaaattgcctaacagttgttaaaattacaaaataaaaattcgttaaatttgagc

SEQ ID NO: 368 - DNA, 4138 bp, Rhynchophorus ferrugineus
ttggaatcatggttcaaaacgggcgccacgaagaaacctaccaaccagaggcccaactctatgctggggcccaggccgacttcggacagcgacattccggtggatgaagattacgccaaacagctggccagcatgtcagaaaaagaagttattgcaagcttcgaggaactactcagtgatatgaaccttaacgatgacaaaaagaaacctttgcgcaacatgtctcttgaacagaagaagagtatgttggtcatgcaaaacaagaacaaaactgatacaggtagtaatagattcaatggccccgaagattattatgcgtacttggaccaacacagtaaaggagagtacattcaactgaacaaattacaaatgtgcgtcgaaagcttaagggtagccctcgctaataacccactgagttgggtagaaagatttggtagcaacggaatgcagatgatactgaaagtcatagaagtgggattgcgacacaaagatgtaaagctgcagtatgagtgtttacgatgcctggagaagttcatgaacaacacatggggcatcaagcacttcttccaaaatgacaacgcccacgttacggtggctaaatgtttggaccacgaaaaaatgcatgttatgacgcaagctttaaagatcttagccccagtatgtttcctttcggagggagaagaaaatggtgccaagaaaatcctgctagcaatcacgaaagttgctgaggacaatgacagggagagattccttccagttgttaatggaattaccaaaactaacaatgcagacttaaagagtatgtgcttccaatttattaacgccttattatctgagactgaagacttcgaatttaggatgcacttaagaaatgaaatagtcaggaatggtttatttgaaaaattcgctgaacttaaaaatgaaaccaatccaatcattaagacccagtttgatgtgttcgagagcgaaaaagaagcggatgcggacgaattacacgatcgattcgacaaagttcggatcgacatggacgacatgcaggactgtttcgaagtgctgaagaacgtcacgttggagacgccttccgagccatattttctcagtatcttgcagcacttgctgtttataagggatgacgtcaacataaggcctgcatactttaagctaatagaagaatgcgtatcccagattgtcctgcacaaatctggtctagacccagatttcaagaagaaccacgtggaactggatcttcaaccattgttagatgaattgaaagataagccattggcagaagataaagggaaatacgaacagctccaaaagcaattggatgaagcattggttgctaagagcgaggcagaggcgaagattgaaatgttgatacaaggtggtgctgtggtagcgactaacaatggcaagctggaccccgcattggtggggaaggttaccattccacctccgccaccaccccccttgccgggtggtagcggagctccgcctccaccacctttgcccggtggcccaccaccgccgccacccattcctggctccaatgcaccaccgccacctccaatgcccattggaggtgggggtccacctccgcctccgatgccaggcatgggtcctcctccaccgccagctcctccaggtttcggtggacctccaccaccacctggtatgggacctccacctcctccctttggaatggttcctttgccgggaatggcgcaggtgaatcaacttccgcacggtcttaaaccgaagaagaagtgggaggtgaagggacctctgaaaaaggctaattggaaggctatattgcctcaaaagttgtcggaaaattccttctgggtcaaagcgaaggaagaagatctggcggaacctgatgttttggatggtctggccaaaaagttctcttccaaacccatgaagatcgcaacggaagatacgggtgacagggttagtaatactggaacacttaaaaaagtgaaggaacttaaggttctggacggaaagactgctcaaaacatatcaatcttacttaacggcagtttgaagcatatgccatatgacgatattaagaaggcattactaagatgcgacgagagtatattgacagataatgttacacaacagttgatacaatacttgccaccaccggaccagttaaacaaattacaagaattcaaggatcagtacaaagatctgacggaggcggagcaattctgtgtaaaaatgtctgaagttaaacgtttattgcccaggcttaagtcgcttagctttaagcatcattacgtagagatggttcaagattcaaaacctgatataacagccgccacattcgcttgcgaacaacttaaaaagagcaaaaaattcgcaaggatattagagctggttctactcatgggtaactatatgaattcaggtagtaaaaacggaggggtatttgcgtttgaaatgagcttcttaacaaaattgactggtacaaaagatagcgaaaataagcaaactttgctacactatatagttgaaactgtagaaacaaaatggccagaactacttaacttttatgatgaaatgccccatattgacaaggcaagtagagtatccttagatgcgatacaaaaaactttaaaacaaatggacagtagcataaggaatctgaaaacagatttacaaaacaatcgagtacctcaaggtgacgacgataaatttattgacgtaatggataattttgctgaaaaagctagggagcaatgtgatattttacagagcatgttcaaaaaaatggaaaatcttttcaacgatattgcagaatattatgcctttgataggcagaaatatccgttagaggaattctttagcgatttgaaaacgtttaaagatagttttatacaagcagcatctgataatcaaaaagagagagaattagaagagaaacgagagaaagcccgcttggccaaactgaaacaggagcaagacaaagaagagaggaacaagaggaaactgatcgatatgaacccacaacagaaccaagaaggagtcatggacagtttacttgaggctttatcgagcggtagtgcgtttagcggccagaagaggaaacgaggaccgcgacctgcaggagctgaaagacgagcccaattacagaggtcacgttcaagaactggtctaattgctggtcgagaattaaccagcgaaattgcaacgtgacaaaacgatgcagccctgtgaaaaataacaacgacaatgataacgctcaaaaaaccgagattgatttttttttggtaaatttaattataagagaaaatttaatgcgcgaattccaagaattaacgcaaaaatttgagtcaaaatttccgagatgagctaagtcctttcggttaaaaaccgattcgtgtaacagttaaaatacattttgtgctaaatcttggattggttcaatcaataatttatttattagatttattagatactaaaacgctgtaaatagatttatattatgttttgtatattagcatttttatatttgtaagtcgaatctccaatagatttttataattactgaacagtgatgttgttttaaacgcagtcttatgaatatgatcgtgatttgtttcttctttgttcgcaaaaaaccacatgcgcgaaaaggactaatgaaaattgttttagttgttgcttgtaactttgcctgatattttaatggtttcttttttttgctgtagcgtaatattaagtgggtccatttctttttcgcgcgttacctattcttgttagattcatatactatcttaggtagaaccatatcaaggaaatagtaattaagttactaaaattatgtaacttacattgttgatacaagacaggtctcttcgaaacattcttgctcattaaagtaatatcgtagaccgttttctaattaatggaggacacaagtccgttaaaacaaaggaatgcctaaatatattatcaaaatacttatagatataaattagatataacgaaattgaatacgctttgagaattacttacttaaacaccattttgtaataaatataaatatatatgtaatcgaaaggaagctaacatgtaataaaactaatattttttataaatatgtggatataaaagcaaatgcaat

SEQ ID NO: 369 - DNA, 2513 bp, Rhynchophorus ferrugineus
atctaaataaaattaagtaagtaaaattaagaaaagctactaggtatttttgtctatatttagggtgtagaaagtgcgttttctatagattgttaagaagtaatcatggtgttgtgatattcattcaacagacttctatattaggaatcaataggtagttttagaaagggtatttgccggcactaatcctcgtgtcttaagttgtcaaatttgtgaaaaatggcggatccaacatttaagagtcgtattcaaaattttaagaacaaagggaaagatcaagatgaaatgcgaagaagacgaaatgaagttacagttgaacttagaaaaaataaacgggaagaaaccttacaaaaaaggcgtaatgttcccgtcgttgactccactgatgaagatgatatggataaagctttgtcaaatattaatttagagcttgtagttactcaagctgaatgtgcggacaatgtagcagtacaattgtcggcagttcaatctgctcgaaaattactatcttcagaccgtaatcctcctatcgatgctttaattcaggcaggcattttgccagcattagtcaaatgtttagaacgcagtgacaatccacctctacagtttgaagctgcttgggctttaactaatattgcatcaggaacatcagcacaaacaaataaagtagtagctgcaggagctgtgcctctgttcctaatgcttttgcaatcaccccaccaaaatgtcagtgaacaagctgtttgggctttaggaaatattataggtgatggacccgtgcttagggattatgttattgagctgggagtagttgaaccacttttatcatttattaaaccagaaattccaatatcattcttaaggaatgttacttgggtcattgtgaatctctgtaggaacaaggatcctccaccaccaattcgtacaattgaagaactgcttcctgccttaagtgctctgatccatcacacagatccaaatattttggtagatactgtttgggctttgagctatctaactgatggtggcaatgatcagatacaaatggttattgatagtggaattgttcccaatttgattccattattaagtcatagagaggttaaagtccagacagctgctttaagggcagttggaaatattgttacaggcactgatgaacagacacaggtagttcttaattgtgatgctctatctcactttccagccttacttactcaccccaaagagaaaatatgtaaagaagctgtttggtttttgtctaacattacagctggaaatcaaaatcaggttcaagctgtaattaatgcaggtcttctacccaaaattatccttaatttgagcaagggtgattttcagacccaaaaagaggctgcttgggccatatccaatttaacaattggtggtacaagagagcaggtagctcgattgctgcaagaaggtgcaattccaccattttgtgatcttcttaattgtaaagatcctacagttatccaggttgtgctggatggtataaacaatatgttaaagatggccggacctgaagttgatcatttgtgcaccatgattgaggagtgcaatggacttgacaagattgaggctttacagaatcatgagaacattgagatttataaattggcttatgatattatagagcaatatttcagtggtgatggcgaagaagatgtaaatttggttccgagtgcgggcgatagtttattcaactttgagccaagcgcgaatgtaccaaatgatggcttcaagttttgatttgtcggggtgtaagaagatttgctcagaaaaagacttgtatcttcgaaatgaaagaatgaactccagcagctttcttgcttccctctttaataaatcacctcaaattaatttaaaatatgtacgttcattttatgtatatatattatatttttttaggaaaattattttatgtaacttattttgttgtaaatttgttatttacaaaacatatatacagccatttactttaagactgccctttttttctgaaataaatggtggtgaaacgatgtatagaaaaattaattaaaatgaccgtacatgatgagaaaaaaatctgggcatgattaactaagcgaattttttactatatatataaatatatgataaatgatggatttttacaataaaactaaattctatttggcaaatagaaactatgttgcaataaaatgatcatgcgcagatgttttattaacatatactgatgtatttatgatattatacatataatctagtttttcatagtaaaaagtggaataaaatgcagatctatttcctaaaaaataaaatttattttaaacattttgacagaaatatgtttttaatattggcaagtaccactggtctcttgctagaatagatttgaggaaaattaattgggataaaaactcaacttgttacttataatttgtttaaattaattaactaagaaaatatgtatgaaattttgttttacataaaccagtaaaatcagaaaa

SEQ ID NO: 370 - DNA, 2899 bp, Rhynchophorus ferrugineus
ctttttagtcgaaactgctgataactatatgtttttaaaatacatataatcttcataatctttataataagcgatttaacgtagtgtgtagcggattatattatttaaatgaatcatttgaccttctcaattatgtgtatcctgtatcatttcaactctattgtaaattttattttacataccgtacatataaaactaaactaaacgtctccgtaagagtcaggaattatttgatgttgtttgcctttctccaaagatgtctggttctgggcacaagcatcgttataagaataccgccttggatagtgttgaattaaggaggcggagagaagaggaaggtatacaacttagaaaacaaaaaagagatcaacaacttagcaaaagacgtaatgtgaatgttaaccaggtagtgcctgaagatgatccattacagaatgaaggagatatgtcatcttctgttatatctggcatttcacaagatatggtacaggatttgtacagttctgatactgaattgcaattattagctactcagaagtttagaaaattgctaagcagagagccaaatccacctatcgatgaagttattcatacgggtattgtgccccgttttgttgaatttttgcaaaatacaaccaactgtacccttcaatttgaagcagcttgggccttaacaaatattgcttctggaacatcacaacaaactcggatggtgattgaagctggtgctgtaccaatttttattgctctcttaagcagtcagtacgaagatgttcaggaacaagctgtatgggcattaggaaatattgctggtgattccccagactgtcgggatcatgtcttggactctggaatattagttcctttacttcaattattagcaaattcctcacgtattaccatggtaagaaatgcagtatgggccctttcaaacttgtgcagaggaaaaaatccaccaccacaatttgccaaagtgtctccatgtttgcctatattagctcgcttgttgtttcatactgatccagatgttttatcggatgcttgttgggccttaagttatttgtctgatggaccaaatgagaaaatacaagctgttattgatgctggggtttgtagaagattggtggaacatttaatggctcctcaaccaaatgttgtatcagcagctttaagagcagtaggaaatattgttactggtgatgatgttcagactcaggtcattttaaattgtactgctttaccatgcttactacacctgctttcttcctccaaagagactgctagaaaggaagcttgctggactattagcaatataactgcaggaaatagatcccaaatacaagctgtcattgatgcaaacattttcccagttttgattgaaatcttgagtaatgctgagttcaagacacgaaaagaagctgcctgggcaattacaaatgcgactagtggaggaactcctgatcaaatacgatatttagtgaatcaaggctgcattaatcctatgtgtaatttattaactgtgatggatcccaaaattgtgcaggttgctctcaatggtttggagaatatattgagactaggtgaacaagaagctaaagcacattctggcaataatccttatgcagttatgattgaagagtgttacggattggacaagatagaattccttcaatcccacgaaaatacggagatttaccagaaatcgtttgacataatcgaacattactttggagccgaggaagaagatactaacataactcctgcgatagacgctaatcatgaccagtaccaattcagttccgaccagtctgtcccgatgggaggatttcaattctaggactgcttagactaaacaattgttaaccttttaaattattactataaactccgtcagaatttttctgaaaaggtgtagaatattacgccatcacctgtacttttgttttgcttttaagaagaccgatggattttggccaacttcaagccatcttttgcgaaaacacccttgttcagtacatttttcaaactacttattggaatttagatcagaattgttgatatattaaagccagattgacttactactgattgaaagaatatatatcttagatatgatttaggctatatcatgatgcaagacttttactggtctttaaattcctggctttatatgagtttttaatggatcatatatcaacacaaagaggaaaaaaaatatcagaattgggtgttaacgatagaattttatacatgtgtatgtatgcttgtctaagttaatgggactgcttattttaatgatccctatccgtttataatttaatgtactttaaacacaaacgttttagtcagttttatacatatttattgaagatgttttaaaatgtttttaaggtacattattatcggttaagtcgacgtctatacactttaataaatatgtatttacttaaatgttataacgctctcgatgtaaaagtcatgctgaatgtctcattgaattcggcttttagtttattaaagtggtatagtgaagccataaaagatttatagttaagaagttttttttatccaaaaagagtgttttattaggttggtgcaattattaccttaaaaaaattgagttttctttagtctttaatatatccactggttgttgtacatacatgtgtaaaattcattaacagtttgtataatatagttgatagtttgtaatataaaacaaaaactagtttcatttttttagttcttttaaatagtctaataagatattacagaataaaatttgtttttgatttgtttttattctttatatggaattgacaacatacaccaagaaagagaaattaagcctacaacttgagagattgattgattttatatttggcatcttgaattaccc

SEQ ID NO: 371 - DNA, 827 bp, Rhynchophorus ferrugineus
ggctgtcatatagtatatttaatttttacaaatcatcttcagatttttttaggtgtaaatctttttgtacttcgtactttaaaaaacagttaacagaagaaaacagtatattgtattttatcattataaattatattttgaaggaaaaatgcctgccggaggtgctctatttggcagaacagctacaggtcctggttcgaccgggggtaacaaacatttagtcgaaatgaaagctggaaaaatgaatttgaaaggaaaaatggtgtatccagacaagcgtaaaggtttattatatatataccagagtgaagattccttaatgcatttttgctggcaagacagaactacaggtgtagttgaagatgatcttattatattccctgatgattgtgaatatgtaaaagtaccccaatgcaccactggaagagcatatttattaaaatttaaattaaccaacaggaaattctttttttggcttcaggaacctaaaacagacaatgatgtcgaacattgtgtaagaattaatgatttattgaataacccttcgaccgctgcccagtcgtcggataggccagagcaggatctgcaggcattattaaacagtatgtctcaggcccaactgatgcaactgtttggtggtgctgaacagatgactggcttgtcaagtctcttagggactatgcgaggaccaggcagtgcacgaactacagttcctgctttaactcatcgtacagcagcaagtacacctaccacaacaacaagcactactgctccacagccaccagcagctacaactccaacaactccccaaaatgccccaataccgg

SEQ ID NO: 372 - DNA, 446 bp, Rhynchophorus ferrugineus
ggcggtctcccagttttctagtgctttagaatctggacaattagggcctgtggtgtcgcaattagcggttaatcctgaagctgtagctgctgctgcttcaggaaatatgcaggaattcgttaaagccctggagaaaaactccggaagtagttctgaaacaaataacaaggacaaaaacaaaggagccaaaaaggatacaaaaaaggatgatgatgacgaggagatgcagctagattgattttaatcagttttcctgtttttaacgacaaacgagcgattcaatggaatatttaatataaaacaattaattcaaatattttataattatcactgatttacttgcaattattacaaattcgtgttttgtgaaagacttgtctatgtttagacgctttttccacttttaattttgtattgtttactcaatatatgtgttttgctttcac

SEQ ID NO: 373 - DNA, 1683 bp, Rhynchophorus ferrugineus
caattttagaagcattacaggacaaaaatttgacgtttggcgcatatttgtatgatatttgttttcttcccaatttttgtatctttgtagtgcaatacgtacaaaaattaaaatggttcttgtcgaaaatgatgtagaaatgaaaaacgctgatagcccacctggccctgaagcaggtgatagcaaacgcgatacagacttgcaaagtttacaggaaatccgagaacatgcaaggcaaattgaaaaagccgtttcaaataaagaaaatcgatttactatgcgaattttaaggtgtttaccgaacactagaagaaaactaaatggtgtggttttacgaagcctgattactcaaatttatcctccatcagaaagggaagcactattggcttttgttgaagaggccactggtgagattgatgcacaaacaagaaccagatctgctacaaagagtccagtaccagaagtggatgcttacataaatctattgattctggtacgtcttattgacaccaatagattagaagagtcgtcaagatgctctcaagctttaatgaataaaataaccagtcaaaatcgtcgaactattgatcatattgctgcaaaatgttacttttatcactctagggtagctgaacttacgaacaggttagattccataagaggatttcttcatgcaagactgcgcactgctacattaagaaatgattttgagggccaagcggtgttgattaattgtttattaaggaattatcttcattattctctttatgatcaagctgacaaattggtttcaaaatgtgtatttcctgaaacagcaagcaataatgaatgggctagatttttatactatctaggaaggattaaagctgcaaggttagagtacagtgtagcccacaaacatttagtccaagctctaaggaaagcaccccagaatactgcggttggatttagacaaactgttcagaaactattagtagttgttgaattgcttttgggagatatccctgaaagacaagtttttagacaatcatctatgcgtcactctttgggttcttatttccaactaacacaggctgttcgtatgggtaatttacaaagattcagtgaggtactggagaattttggcccacagttccggcaagatcatacctatacattaatacttcgtcttcgtcataatgttattaaaactgcgattagaagtattggtttatcatactcaagaatttccccacaagatattgcaaaaaagctaggcttagattcagctgaagatgctgagtttattgtagctaaagccattagggatggtgttattgaggcaactttggatcctcaaggaggatatatgaggagtaaagaaagtacagatatttactgtactaaagaacctcagatggctttccatcaaagaatatcattctgtcttgatttacataaccagagtgttaaggcaatgagatatccacctaaagcttatggaaaggaattagaaagtgctgaagaaagaagagaaagggagcaacaagacttggagcttgccaaagaaatggcagaggaagatgatgatggtttcccttaaaatattttatttacttattatttttcaatggtgtaataatagattgtttgctttagtatttaaatgaaatttaagaacataaaaaaaacttttcataatcc

SEQ ID NO: 374 - DNA, 563 bp, Rhynchophorus ferrugineus
ggtcgtaaagctatgtttgatagtgattataaagcggcagataagtatttaagttatgcatttgaaaattgccataaagtgtctcaaaaaaacaaacgattaattctaatatatttggtaccagtgaaaattcttcttggctatatacccaatagaaaagtattagaaaaatataatgtattagaattctgggacctggtgcaagctgtgtgtcaagggaatctgaaatggtttgatgaaatcatggagaaacatgaatccttttttattgcctgtggcatttatttgattgttgataaattaaagataatcgcttataggaatttgttcaaaaaagtttacttaatattaagtactcaccagattcctgtggaatcattacaaactgctttggagtttttagggcaggatgttgatttagatgaaactcagtgcatagtagcaaatctaattaacgagggaaagataaaaggttatatttcccatcagcatcgaaaagttgttgtcagtaaacagaatccttttccaccacttacatctacttgaacagatgtcatcagctt

SEQ ID NO: 375 - DNA, 1755 bp, Rhynchophorus ferrugineus
ctcattttcaatttacttctcgatatacaaatttaatggcaattagcctcagaagaataaagaagaggagaaacgtcaaatttgacaaggccaaattagaaataccttaagaaaacaaatctgggatatactattttcataaattcaaataaactatagctgctaaagttattctatactaatgaaatggcatctgctttagagcagtttgtaaacacagtaagaaatctttcatcgcacggtaactttagagaactgtatgaaattattacgaagtcgaatgaagtattaagtaaaaatgtccagcatctagataatgttctggaaaccttagatgttcaacaacattctctaggagttctagctgtactattggcaaaatttaatagtccaaatgtgtctctgccagacaacagatttttacaagctcaagaattcctgaccaattgcaatattgaacaagttagaagtgccccagacttatttgctgagttttgtcatttgtttacgaattatttagtagaacagaagcaaccgataaaaggtatcagtcttcttaaacaggcccttataagactgaagtatgtatctaaagctcaacttacttcaatccatgctgatttgtgccagttgtgtctgctggccaaatgtttcaagccagcattagagatattagatgttgatatcataagtatttgtcaagagatcacccacactaatgtgaccagcccccaatttgatgcaaaatattttctcctctattattactatggaggaaaaatttacttagcactgaggaatctagatagagctttgtatttttttgaaatagctctaactacaccagctcatgcggtttcccatattatgttagaagcttacaaaaaatatattttagtttctttgttattgcatggaaaggtgcatgggattcctaaatattctgcgaaagtggttggaagatttattaaacccttatctttaccatatattgatttagcatctgcttttattattaacaataccactgaattgaataatataattacgaaacatacggaagtttttacgagagaccacaatatgggtttgattaaacaagtatcacaagtgctctataagaaaaacatacaaaggcttactaaaaccttcctgaccctgagtttaaccgacgttgccagcagagttggtttacctggtcctgctgatgctgaaaaacacattttgcatatgatcgagaacggtaaaatatacgccaccattaatcaaagggatggcatggtagtatttagggatgaaccagataaatacagcgggccccaggtattgaaaacattagaagaagaattagctttatgtatggagctcgataatcgaatcttatgcatggacgaggaaatacaggtcaatcctcaatatgtcaaaaagacatccggcttacaggatgacgaacaaccatcaaaaagcacatatgcgatgtaatgctcgcgccaaaatcaaccacacgttgaatttttccgttgtataaacttactacaccttacgaatttcgtttttttttaggccgtttatgattggaaatagtgatttcgttagcaactcgcagacatttctattacgagtgcaagttaacactaaaaaaatctaatacattatttaaaatatattttaacacataaaaaaatgttgttaatatgatacccgcccacaaaaaaaatcaaccgcgctactgttaaccaaaactaaatcctgcca

SEQ ID NO: 376 - DNA, 2882 bp, Rhynchophorus ferrugineus
  misc_feature (2087)..(2147): n is a, c, g, t or u
cttcctatcataatgatatttaaggttaagtacctttgtttttaaagttgttgatcatttttatttgaaaatcacaacgatgggagaaagtcaacaaaaatcacccagtgaacgaaactgtgacgaattcatatatgatgatattgataacgagatttttgcaacaacccaacgccctgacgaaaacgtatcacctccacaaccgaataatgatttacttgaagagaacaaaaatctaagggagtcacttcttcaattacaagaagcaaatgcccttttagagacgagaatatcacaactatatcttacagcaaaaattgaaatagagagaaaggaaaaccaaataaatgagatgaaaatcgaaagagaaaatatggtatttcgtcggaataatcgctatcaacattcaggcaatgcgaaatttcctataaacagattctacaaacaaaatattgaaggaagtggtgttaaatcaggccagttgcatcataacacaacagataataaatatgacaaaaattctgaatccaaatgtaacaaagagtctgaaaaacctatatctgttaatacaaagtctgaatgtaccaatcatcataacaaggacagtatacctgatgaaactttgggaaaaaacagcgtgatggaaaagagtgtatacaatacaaatgtagattctgttaacacagattcagggaaacattcagatgactcatccaagaaatactcaaatgatgtgatgcccagtttaaatcaaacatataggattcctaaaaagattgccacagatgataatgacataaatgaaagtgctcacattgagtcaaagcatcatggaaatgtttacgaaataaagggaaacaaagaagatgccagagacgcgggatctagttacacaagaaacaaaaaccacccagaaattcaaaagaaatttaaccaggaccgagtcagaaacggacatgatcagcttcaccccgaaaataaagaaaggtactctgaatcgatgaaacaggaacgaaaatattactttagttcaaaggatagagacaaagatggatatcaacacgttaaaagatcttcatcaagcaaatcgagaactccagatagagatcggcccaacaaatttactgtgagagatagagacgggaaacaacaggttagaagacattccagaagtagatcgagatctccagagagagatagacctaatagatctagtctgagagacagagatgggaatggcagggatggatatcaacacgttagaaggaatcccagaagtagatcgaaaaccatatcaagggatcggaggaagtctcatcatatacctaaaagcagtaaccgaagatctaggtctttgtccagagagaggcttaatacaagaataatgatgaatgttagacctggcgagagaatccaaagaagacgtgagtccaaggaatgttttagggacaagtttttgaagagaacccatgaaatttcccatgttgatgtcaggagtaccgctgaaaatattccgcaaaacaagaagagtggctttaaagataccgagtctctttacagcgaagatgaaatcaaacttttcctgtctggtgaaagtgattttgaaggtgacacaagcattaacaagcaccaattacctgatgtttccaaaatgagtatggggaaactggagagactccatatagaattaagacaacacattgctaaatataaaccaggtaaatttccttctctgcagtttagtgaagatgatcttaacgtccaccatggctttttagaaggtgattatgattgcaatgatgtatgtgaaagagaatctgatgatgataataaaaacgagatggacgggcgaaacaaatcacacgcccaagcagaagacaacaaactattctatcatagaaatgtgcaaaattcggaacgtttcagtaagaaaaaactaattgaagatcgtgccagtttgagtgaaaatggtgctgctgctaacaaaaatactgataaggctaaaaaacttaaatttaaaggagatgttgagaaaacacgaggagctgctgatagcactgccgtatcagcttctacatctaagaacnnnnnnnnnnnnnnnnnnnnnnnnnnnnnnnnnnnnnnnnnnnnnnnnnnnnnnnnnnnnntgctacacatgaaccaaaaaacagtaaaactcaaaatataacattagatcagtacaaaaaacgtcatgctcctacatcgggagggacctttaaaaataaagaccctttcaagttttctgataccgataacaccgatgatagtatggcttcgaaaaagccagatagtgataaaatggtggtaatccaacaacctgtagttgaaacagaaaataagattccctctgatatcgatagcgctgttattgatatattagaatcagaaccaaataataccaaaaaaatcgtggaagttggcacggttttacctgaggataaaaatactaattcacatattgaagagaagccaaaatcgaagcctgaagcacataccaacattaaagatcacactagtaaagcaggccatgaaaaaacagtggattgtttaaatgatgaaaataaacacatagacataaacgtcggaattaaaacgaattctcagaacaaagctaaagaacaccatcaaaacggacaatccgcaaatgatcaatcatttctgaaaaatggtaaaaacaaaattacagacgagccagccaaagattcaatcaaaaaggaaactttgaaacgtcaatcaaaaacgagtgatctcgctacgaaggaagaaaagatcgacgaaggtcgtgaacagaaacatcaaggtggtcatggagaatcaagtcaagaaatatcgagaacgaagcctagtgccgataaagagaa

The invention claimed is:

1. A dsRNA for controlling infestation of a plant with red palm weevil (*Rhynchophorus ferrugineus*), the dsRNA comprising a polynucleotide sequence comprising at least 140 bp and being about 85% to about 100% complementary to a segment of a target gene of the red palm weevil, wherein the target gene is a proteasomal beta-subunit gene having the coding sequence as set forth in SEQ ID NO: 3 or SEQ ID NO: 317; and wherein when the dsRNA is topically applied or injected into plants and the plant is ingested by said red palm weevil, mortality and/or stunting of said red palm weevil is instigated.

2. The dsRNA of claim 1, wherein the dsRNA comprises at least 200 bp.

3. The dsRNA of claim 1, wherein the dsRNA comprises a polynucleotide sequence which is about 95% to about 100% complementary to the segment of the target gene of the red palm weevil.

4. A composition comprising the dsRNA construct of claim 1.

5. A method for preventing, ameliorating and/or treating infestation of a plant with red palm weevil (*Rhynchophorus ferrugineus*), the method comprising providing to the plant the dsRNA of claim 1.

6. The method of claim 5, wherein the providing of the dsRNA to the plant comprises applying the dsRNA or a composition comprising same on the plant; wherein the applying comprises one or more of the following:
   injecting the dsRNA or a composition comprising same into the plant;
   spraying the dsRNA or a composition comprising same into or onto the plant;
   delivering the composition to the plant by absorption through the soil;
   placing a feeding source comprising the dsRNA in proximity to the plant or the red palm weevil; and
   applying a composition comprising bacteria and/or virus expressing the dsRNA on the plant or any combination thereof.

7. The method of claim 6, wherein the providing of the dsRNA to the plant comprises injecting the dsRNA or a composition comprising same into a trunk of the plant.

8. The method of claim 5, wherein the red palm weevil is a red palm weevil larvae.

9. The method of claim 5, wherein the plant is a palm tree of the Arecaceae family.

* * * * *